United States Patent 7,901,882 (ANALYSIS OF METHYLATION USING NUCLEIC ACID ARRAYS) - sequence listing, part 20

SEQ ID NO: 720843 - DNA, 25 bp, Artificial sequence
  Synthetic oligonucleotide
acgtcttcgactccaacgagaccct

SEQ ID NO: 720844 - DNA, 25 bp, Artificial sequence
  Synthetic oligonucleotide
gccaacggcaacatctgcgtcgcct

SEQ ID NO: 720845 - DNA, 25 bp, Artificial sequence
  Synthetic oligonucleotide
atcggttacaacgtggccaaggtca

SEQ ID NO: 720846 - DNA, 25 bp, Artificial sequence
  Synthetic oligonucleotide
cttccaggccgctgcccgcgccgaa

SEQ ID NO: 720847 - DNA, 25 bp, Artificial sequence
  Synthetic oligonucleotide
ggacgtcttccaggccgctgcccgc

SEQ ID NO: 720848 - DNA, 25 bp, Artificial sequence
  Synthetic oligonucleotide
tccggggacgtcttccaggccgctg

SEQ ID NO: 720849 - DNA, 25 bp, Artificial sequence
  Synthetic oligonucleotide
tcggctattccggggacgtcttcca

SEQ ID NO: 720850 - DNA, 25 bp, Artificial sequence
  Synthetic oligonucleotide
tgcccgcgccgaagaggccggcaag

SEQ ID NO: 720851 - DNA, 25 bp, Artificial sequence
  Synthetic oligonucleotide
gcaacatctgcgtcgccttcggcta

SEQ ID NO: 720852 - DNA, 25 bp, Artificial sequence
  Synthetic oligonucleotide
cgccgaagaggccggcaagggcatc

SEQ ID NO: 720853 - DNA, 25 bp, Artificial sequence
  Synthetic oligonucleotide
atctccgacctggccaacggcaaca

SEQ ID NO: 720854 - DNA, 25 bp, Artificial sequence
  Synthetic oligonucleotide
aagtacatctccgacctggccaacg

SEQ ID NO: 720855 - DNA, 25 bp, Artificial sequence
  Synthetic oligonucleotide
ctcctccaagtacatctccgacctg

SEQ ID NO: 720856 - DNA, 25 bp, Artificial sequence
  Synthetic oligonucleotide
cttccactcctccaagtacatctcc

SEQ ID NO: 720857 - DNA, 25 bp, Artificial sequence
  Synthetic oligonucleotide
cagctacttccactcctccaagtac

SEQ ID NO: 720858 - DNA, 25 bp, Artificial sequence
  Synthetic oligonucleotide
tacgtcagctacttccactcctcca

SEQ ID NO: 720859 - DNA, 25 bp, Artificial sequence
  Synthetic oligonucleotide
ctgcgtcgccttcggctattccggg

SEQ ID NO: 720860 - DNA, 25 bp, Artificial sequence
  Synthetic oligonucleotide
cccaaggaaggcgccaacctgtggt

SEQ ID NO: 720861 - DNA, 25 bp, Artificial sequence
  Synthetic oligonucleotide
attcccgccgatgccaaggccgccg

SEQ ID NO: 720862 - DNA, 25 bp, Artificial sequence
  Synthetic oligonucleotide
tggcgattcccgccgatgccaaggc

SEQ ID NO: 720863 - DNA, 25 bp, Artificial sequence
  Synthetic oligonucleotide
acctgatggcgattcccgccgatgc

SEQ ID NO: 720864 - DNA, 25 bp, Artificial sequence
  Synthetic oligonucleotide
gttcgacctgatggcgattcccgcc

SEQ ID NO: 720865 - DNA, 25 bp, Artificial sequence
  Synthetic oligonucleotide
ctgtggttcgacctgatggcgattc

SEQ ID NO: 720866 - DNA, 25 bp, Artificial sequence
  Synthetic oligonucleotide
ggccgctgcccgcgccgaagaggcc

SEQ ID NO: 720867 - DNA, 25 bp, Artificial sequence
  Synthetic oligonucleotide
gaaggcgccaacctgtggttcgacc

SEQ ID NO: 720868 - DNA, 25 bp, Artificial sequence
  Synthetic oligonucleotide
ctgaccaaggttcgcccctacgtca

SEQ ID NO: 720869 - DNA, 25 bp, Artificial sequence
  Synthetic oligonucleotide
cgtgattcccaaggaaggcgccaac

SEQ ID NO: 720870 - DNA, 25 bp, Artificial sequence
  Synthetic oligonucleotide
ccagtacgtgattcccaaggaaggc

SEQ ID NO: 720871 - DNA, 25 bp, Artificial sequence
  Synthetic oligonucleotide
cgacatccagtacgtgattcccaag

SEQ ID NO: 720872 - DNA, 25 bp, Artificial sequence
  Synthetic oligonucleotide
gggcatcgacatccagtacgtgatt

SEQ ID NO: 720873 - DNA, 25 bp, Artificial sequence
  Synthetic oligonucleotide
cggcaagggcatcgacatccagtac

SEQ ID NO: 720874 - DNA, 25 bp, Artificial sequence
  Synthetic oligonucleotide
agaggccggcaagggcatcgacatc

SEQ ID NO: 720875 - DNA, 25 bp, Artificial sequence
  Synthetic oligonucleotide
gccaacctgtggttcgacctgatgg

SEQ ID NO: 720876 - DNA, 25 bp, Artificial sequence
  Synthetic oligonucleotide
actcctgggccatcctcttcgagcc

SEQ ID NO: 720877 - DNA, 25 bp, Artificial sequence
  Synthetic oligonucleotide
tcgccaagtgcggcgtggccttcat

SEQ ID NO: 720878 - DNA, 25 bp, Artificial sequence
  Synthetic oligonucleotide
agaagctcgccaagtgcggcgtggc

SEQ ID NO: 720879 - DNA, 25 bp, Artificial sequence
  Synthetic oligonucleotide
acatgaagaagctcgccaagtgcgg

SEQ ID NO: 720880 - DNA, 25 bp, Artificial sequence
  Synthetic oligonucleotide
cggagaacatgaagaagctcgccaa

SEQ ID NO: 720881 - DNA, 25 bp, Artificial sequence
  Synthetic oligonucleotide
tcgagccggagaacatgaagaagct

SEQ ID NO: 720882 - DNA, 25 bp, Artificial sequence
  Synthetic oligonucleotide
tcgcccctacgtcagctacttccac

SEQ ID NO: 720883 - DNA, 25 bp, Artificial sequence
  Synthetic oligonucleotide
gggccatcctcttcgagccggagaa

SEQ ID NO: 720884 - DNA, 25 bp, Artificial sequence
  Synthetic oligonucleotide
gccttcatggacagcggcgacgaga

SEQ ID NO: 720885 - DNA, 25 bp, Artificial sequence
  Synthetic oligonucleotide
cgatcgactcctgggccatcctctt

SEQ ID NO: 720886 - DNA, 25 bp, Artificial sequence
  Synthetic oligonucleotide
accagccgatcgactcctgggccat

SEQ ID NO: 720887 - DNA, 25 bp, Artificial sequence
  Synthetic oligonucleotide
tcggcgaccagccgatcgactcctg

SEQ ID NO: 720888 - DNA, 25 bp, Artificial sequence
  Synthetic oligonucleotide
aagtcctcggcgaccagccgatcga

SEQ ID NO: 720889 - DNA, 25 bp, Artificial sequence
  Synthetic oligonucleotide
caaggaagtcctcggcgaccagccg

SEQ ID NO: 720890 - DNA, 25 bp, Artificial sequence
  Synthetic oligonucleotide
caaggtcaaggaagtcctcggcgac

SEQ ID NO: 720891 - DNA, 25 bp, Artificial sequence
  Synthetic oligonucleotide
tcctcttcgagccggagaacatgaa

SEQ ID NO: 720892 - DNA, 25 bp, Artificial sequence
  Synthetic oligonucleotide
ccgccctcaactatctggggctgga

SEQ ID NO: 720893 - DNA, 25 bp, Artificial sequence
  Synthetic oligonucleotide
tggctcgttcgctggccaagcggcc

SEQ ID NO: 720894 - DNA, 25 bp, Artificial sequence
  Synthetic oligonucleotide
gccgaggaagtcctgaccaaggttc

SEQ ID NO: 720895 - DNA, 25 bp, Artificial sequence
  Synthetic oligonucleotide
caagaaggccgaggaagtcctgacc

SEQ ID NO: 720896 - DNA, 25 bp, Artificial sequence
  Synthetic oligonucleotide
ggactacaagaaggccgaggaagtc

SEQ ID NO: 720897 - DNA, 25 bp, Artificial sequence
  Synthetic oligonucleotide
cccgaaggactacaagaaggccgag

SEQ ID NO: 720898 - DNA, 25 bp, Artificial sequence
  Synthetic oligonucleotide
cacccacgacccgaaggactacaag

SEQ ID NO: 720899 - DNA, 25 bp, Artificial sequence
  Synthetic oligonucleotide
aagtgcggcgtggccttcatggaca

SEQ ID NO: 720900 - DNA, 25 bp, Artificial sequence
  Synthetic oligonucleotide
tcaactatctggggctggaccccaa

SEQ ID NO: 720901 - DNA, 25 bp, Artificial sequence
  Synthetic oligonucleotide
ggcgtggccttcatggacagcggcg

SEQ ID NO: 720902 - DNA, 25 bp, Artificial sequence
  Synthetic oligonucleotide
tgcccgccgccctcaactatctggg

SEQ ID NO: 720903 - DNA, 25 bp, Artificial sequence
  Synthetic oligonucleotide
gatgctgcccgccgccctcaactat

SEQ ID NO: 720904 - DNA, 25 bp, Artificial sequence
  Synthetic oligonucleotide
gacgagatgctgcccgccgccctca

SEQ ID NO: 720905 - DNA, 25 bp, Artificial sequence
  Synthetic oligonucleotide
agcggcgacgagatgctgcccgccg

SEQ ID NO: 720906 - DNA, 25 bp, Artificial sequence
  Synthetic oligonucleotide
atggacagcggcgacgagatgctgc

SEQ ID NO: 720907 - DNA, 25 bp, Artificial sequence
  Synthetic oligonucleotide
aaggttcgcccctacgtcagctact

SEQ ID NO: 720908 - DNA, 25 bp, Artificial sequence
  Synthetic oligonucleotide
atctggggctggaccccaacaccca

SEQ ID NO: 720909 - DNA, 25 bp, Artificial sequence
  Synthetic oligonucleotide
gctgctgatcatgatgccgacctgg

SEQ ID NO: 720910 - DNA, 25 bp, Artificial sequence
  Synthetic oligonucleotide
atcgcggtgtacatcggcatcgtct

SEQ ID NO: 720911 - DNA, 25 bp, Artificial sequence
  Synthetic oligonucleotide
gatccgggtctatgcctggatgggc

SEQ ID NO: 720912 - DNA, 25 bp, Artificial sequence
  Synthetic oligonucleotide
gatcctgatccgggtctatgcctgg

SEQ ID NO: 720913 - DNA, 25 bp, Artificial sequence
  Synthetic oligonucleotide
gacggcgatcctgatccgggtctat

SEQ ID NO: 720914 - DNA, 25 bp, Artificial sequence
  Synthetic oligonucleotide
gacctggacggcgatcctgatccgg

SEQ ID NO: 720915 - DNA, 25 bp, Artificial sequence
  Synthetic oligonucleotide
gcctggatgggcatcctttccaaca

SEQ ID NO: 720916 - DNA, 25 bp, Artificial sequence
  Synthetic oligonucleotide
gatcatgatgccgacctggacggcg

SEQ ID NO: 720917 - DNA, 25 bp, Artificial sequence
  Synthetic oligonucleotide
atgggcatcctttccaacaacggcc

SEQ ID NO: 720918 - DNA, 25 bp, Artificial sequence
  Synthetic oligonucleotide
tcctgctgctgctgatcatgatgcc

SEQ ID NO: 720919 - DNA, 25 bp, Artificial sequence
  Synthetic oligonucleotide
cagaccgtcctgctgctgctgatca

SEQ ID NO: 720920 - DNA, 25 bp, Artificial sequence
  Synthetic oligonucleotide
tcctcgcagaccgtcctgctgctgc

SEQ ID NO: 720921 - DNA, 25 bp, Artificial sequence
  Synthetic oligonucleotide
agccagtcctcgcagaccgtcctgc

SEQ ID NO: 720922 - DNA, 25 bp, Artificial sequence
  Synthetic oligonucleotide
cgctccagccagtcctcgcagaccg

SEQ ID NO: 720923 - DNA, 25 bp, Artificial sequence
  Synthetic oligonucleotide
atcgcccgctccagccagtcctcgc

SEQ ID NO: 720924 - DNA, 25 bp, Artificial sequence
  Synthetic oligonucleotide
gatgccgacctggacggcgatcctg

SEQ ID NO: 720925 - DNA, 25 bp, Artificial sequence
  Synthetic oligonucleotide
atggggctggggctcatcagcgagc

SEQ ID NO: 720926 - DNA, 25 bp, Artificial sequence
  Synthetic oligonucleotide
agcgggtggccctggctcgttcgct

SEQ ID NO: 720927 - DNA, 25 bp, Artificial sequence
  Synthetic oligonucleotide
ctcaataccaacatcgcggtgtaca

SEQ ID NO: 720928 - DNA, 25 bp, Artificial sequence
  Synthetic oligonucleotide
accatcctcaataccaacatcgcgg

SEQ ID NO: 720929 - DNA, 25 bp, Artificial sequence
  Synthetic oligonucleotide
ccgctgaccatcctcaataccaaca

SEQ ID NO: 720930 - DNA, 25 bp, Artificial sequence
  Synthetic oligonucleotide
agcgagccgctgaccatcctcaata

SEQ ID NO: 720931 - DNA, 25 bp, Artificial sequence
  Synthetic oligonucleotide
ggtctatgcctggatgggcatcctt

SEQ ID NO: 720932 - DNA, 25 bp, Artificial sequence
  Synthetic oligonucleotide
ctggggctcatcagcgagccgctga

SEQ ID NO: 720933 - DNA, 25 bp, Artificial sequence
  Synthetic oligonucleotide
acccgatggcctacgccatcgcccg

SEQ ID NO: 720934 - DNA, 25 bp, Artificial sequence
  Synthetic oligonucleotide
gtactgatggggctggggctcatca

SEQ ID NO: 720935 - DNA, 25 bp, Artificial sequence
  Synthetic oligonucleotide
aaacagcgtactgatggggctgggg

SEQ ID NO: 720936 - DNA, 25 bp, Artificial sequence
  Synthetic oligonucleotide
ctgctaaacagcgtactgatggggc

SEQ ID NO: 720937 - DNA, 25 bp, Artificial sequence
  Synthetic oligonucleotide
aacggcctgctaaacagcgtactga

SEQ ID NO: 720938 - DNA, 25 bp, Artificial sequence
  Synthetic oligonucleotide
tccaacaacggcctgctaaacagcg

SEQ ID NO: 720939 - DNA, 25 bp, Artificial sequence
  Synthetic oligonucleotide
atcctttccaacaacggcctgctaa

SEQ ID NO: 720940 - DNA, 25 bp, Artificial sequence
  Synthetic oligonucleotide
gctcatcagcgagccgctgaccatc

SEQ ID NO: 720941 - DNA, 25 bp, Artificial sequence
  Synthetic oligonucleotide
tcgcctacgcggaccagcagttgca

SEQ ID NO: 720942 - DNA, 25 bp, Artificial sequence
  Synthetic oligonucleotide
gcaactacctgatgctgaccgatga

SEQ ID NO: 720943 - DNA, 25 bp, Artificial sequence
  Synthetic oligonucleotide
acctcggcaactacctgatgctgac

SEQ ID NO: 720944 - DNA, 25 bp, Artificial sequence
  Synthetic oligonucleotide
cctcaacctcggcaactacctgatg

SEQ ID NO: 720945 - DNA, 25 bp, Artificial sequence
  Synthetic oligonucleotide
aggtgctcctcaacctcggcaacta

SEQ ID NO: 720946 - DNA, 25 bp, Artificial sequence
  Synthetic oligonucleotide
cagttgcaggtgctcctcaacctcg

SEQ ID NO: 720947 - DNA, 25 bp, Artificial sequence
  Synthetic oligonucleotide
tacgccatcgcccgctccagccagt

SEQ ID NO: 720948 - DNA, 25 bp, Artificial sequence
  Synthetic oligonucleotide
acgcggaccagcagttgcaggtgct

SEQ ID NO: 720949 - DNA, 25 bp, Artificial sequence
  Synthetic oligonucleotide
accgatgacccgctctacatcgatg

SEQ ID NO: 720950 - DNA, 25 bp, Artificial sequence
  Synthetic oligonucleotide
gatcttcgcctacgcggaccagcag

SEQ ID NO: 720951 - DNA, 25 bp, Artificial sequence
  Synthetic oligonucleotide
taccgagatcttcgcctacgcggac

SEQ ID NO: 720952 - DNA, 25 bp, Artificial sequence
  Synthetic oligonucleotide
ccctataccgagatcttcgcctacg

SEQ ID NO: 720953 - DNA, 25 bp, Artificial sequence
  Synthetic oligonucleotide
atcccgccctataccgagatcttcg

SEQ ID NO: 720954 - DNA, 25 bp, Artificial sequence
  Synthetic oligonucleotide
gtggccatcccgccctataccgaga

SEQ ID NO: 720955 - DNA, 25 bp, Artificial sequence
  Synthetic oligonucleotide
tggcggaagcggacgtggccatccc

SEQ ID NO: 720956 - DNA, 25 bp, Artificial sequence
  Synthetic oligonucleotide
accagcagttgcaggtgctcctcaa

SEQ ID NO: 720957 - DNA, 25 bp, Artificial sequence
  Synthetic oligonucleotide
tcgctgaagatggccttcatcagta

SEQ ID NO: 720958 - DNA, 25 bp, Artificial sequence
  Synthetic oligonucleotide
gtgtacatcggcatcgtctattcct

SEQ ID NO: 720959 - DNA, 25 bp, Artificial sequence
  Synthetic oligonucleotide
tgggctacccgatggcctacgccat

SEQ ID NO: 720960 - DNA, 25 bp, Artificial sequence
  Synthetic oligonucleotide
tgctggtgggctacccgatggccta

SEQ ID NO: 720961 - DNA, 25 bp, Artificial sequence
  Synthetic oligonucleotide
tctgcctgctggtgggctacccgat

SEQ ID NO: 720962 - DNA, 25 bp, Artificial sequence
  Synthetic oligonucleotide
accctgatctgcctgctggtgggct

SEQ ID NO: 720963 - DNA, 25 bp, Artificial sequence
  Synthetic oligonucleotide
atcagtaccctgatctgcctgctgg

SEQ ID NO: 720964 - DNA, 25 bp, Artificial sequence
  Synthetic oligonucleotide
acctgatgctgaccgatgacccgct

SEQ ID NO: 720965 - DNA, 25 bp, Artificial sequence
  Synthetic oligonucleotide
aagatggccttcatcagtaccctga

SEQ ID NO: 720966 - DNA, 25 bp, Artificial sequence
  Synthetic oligonucleotide
tgctgaccgatgacccgctctacat

SEQ ID NO: 720967 - DNA, 25 bp, Artificial sequence
  Synthetic oligonucleotide
ctcggctcgctgaagatggccttca

SEQ ID NO: 720968 - DNA, 25 bp, Artificial sequence
  Synthetic oligonucleotide
gcctacctcggctcgctgaagatgg

SEQ ID NO: 720969 - DNA, 25 bp, Artificial sequence
  Synthetic oligonucleotide
atcgatgcctacctcggctcgctga

SEQ ID NO: 720970 - DNA, 25 bp, Artificial sequence
  Synthetic oligonucleotide
ctctacatcgatgcctacctcggct

SEQ ID NO: 720971 - DNA, 25 bp, Artificial sequence
  Synthetic oligonucleotide
gacccgctctacatcgatgcctacc

SEQ ID NO: 720972 - DNA, 25 bp, Artificial sequence
  Synthetic oligonucleotide
tggcctacgccatcgcccgctccag

SEQ ID NO: 720973 - DNA, 25 bp, Artificial sequence
  Synthetic oligonucleotide
ggccttcatcagtaccctgatctgc

SEQ ID NO: 720974 - DNA, 25 bp, Artificial sequence
  Synthetic oligonucleotide
gaccctgatgatcggcaaggtgctc

SEQ ID NO: 720975 - DNA, 25 bp, Artificial sequence
  Synthetic oligonucleotide
accaacatcgcggtgtacatcggca

SEQ ID NO: 720976 - DNA, 25 bp, Artificial sequence
  Synthetic oligonucleotide
ttcaacaaccgcgactggccggtgg

SEQ ID NO: 720977 - DNA, 25 bp, Artificial sequence
  Synthetic oligonucleotide
ggagttcttcaacaaccgcgactgg

SEQ ID NO: 720978 - DNA, 25 bp, Artificial sequence
  Synthetic oligonucleotide
ctggcaggagttcttcaacaaccgc

SEQ ID NO: 720979 - DNA, 25 bp, Artificial sequence
  Synthetic oligonucleotide
ggtgctctggcaggagttcttcaac

SEQ ID NO: 720980 - DNA, 25 bp, Artificial sequence
  Synthetic oligonucleotide
gactggccggtggcgtccgccctgg

SEQ ID NO: 720981 - DNA, 25 bp, Artificial sequence
  Synthetic oligonucleotide
gatgatcggcaaggtgctctggcag

SEQ ID NO: 720982 - DNA, 25 bp, Artificial sequence
  Synthetic oligonucleotide
cggtggcgtccgccctggcggtggt

SEQ ID NO: 720983 - DNA, 25 bp, Artificial sequence
  Synthetic oligonucleotide
cccgagaccctgatgatcggcaagg

SEQ ID NO: 720984 - DNA, 25 bp, Artificial sequence
  Synthetic oligonucleotide
ggcggccccgagaccctgatgatcg

SEQ ID NO: 720985 - DNA, 25 bp, Artificial sequence
  Synthetic oligonucleotide
ctgctcggcggccccgagaccctga

SEQ ID NO: 720986 - DNA, 25 bp, Artificial sequence
  Synthetic oligonucleotide
ccggaactgctcggcggccccgaga

SEQ ID NO: 720987 - DNA, 25 bp, Artificial sequence
  Synthetic oligonucleotide
gtcatcccggaactgctcggcggcc

SEQ ID NO: 720988 - DNA, 25 bp, Artificial sequence
  Synthetic oligonucleotide
gagttcgtcatcccggaactgctcg

SEQ ID NO: 720989 - DNA, 25 bp, Artificial sequence
  Synthetic oligonucleotide
cggcaaggtgctctggcaggagttc

SEQ ID NO: 720990 - DNA, 25 bp, Artificial sequence
  Synthetic oligonucleotide
tcatcccgatcatcctgttcaacaa

SEQ ID NO: 720991 - DNA, 25 bp, Artificial sequence
  Synthetic oligonucleotide
ccgctgacgatcgaagcggcgctgg

SEQ ID NO: 720992 - DNA, 25 bp, Artificial sequence
  Synthetic oligonucleotide
caaagaactggagggcaaggtatga

SEQ ID NO: 720993 - DNA, 25 bp, Artificial sequence
  Synthetic oligonucleotide
ccaggccaaagaactggagggcaag

SEQ ID NO: 720994 - DNA, 25 bp, Artificial sequence
  Synthetic oligonucleotide
aagaaccaggccaaagaactggagg

SEQ ID NO: 720995 - DNA, 25 bp, Artificial sequence
  Synthetic oligonucleotide
ttcaacaagaaccaggccaaagaac

SEQ ID NO: 720996 - DNA, 25 bp, Artificial sequence
  Synthetic oligonucleotide
aaccgcgactggccggtggcgtccg

SEQ ID NO: 720997 - DNA, 25 bp, Artificial sequence
  Synthetic oligonucleotide
ccgatcatcctgttcaacaagaacc

SEQ ID NO: 720998 - DNA, 25 bp, Artificial sequence
  Synthetic oligonucleotide
ttcatcccggcggtgggcgagttcg

SEQ ID NO: 720999 - DNA, 25 bp, Artificial sequence
  Synthetic oligonucleotide
tcctgatcatcccgatcatcctgtt

SEQ ID NO: 721000 - DNA, 25 bp, Artificial sequence
  Synthetic oligonucleotide
tggcgatcctgatcatcccgatcat

SEQ ID NO: 721001 - DNA, 25 bp, Artificial sequence
  Synthetic oligonucleotide
tgatgctggcgatcctgatcatccc

SEQ ID NO: 721002 - DNA, 25 bp, Artificial sequence
  Synthetic oligonucleotide
cggtggtgatgctggcgatcctgat

SEQ ID NO: 721003 - DNA, 25 bp, Artificial sequence
  Synthetic oligonucleotide
ccctggcggtggtgatgctggcgat

SEQ ID NO: 721004 - DNA, 25 bp, Artificial sequence
  Synthetic oligonucleotide
cgtccgccctggcggtggtgatgct

SEQ ID NO: 721005 - DNA, 25 bp, Artificial sequence
  Synthetic oligonucleotide
atcctgttcaacaagaaccaggcca

SEQ ID NO: 721006 - DNA, 25 bp, Artificial sequence
  Synthetic oligonucleotide
tgccgctctacgccaacctggtgaa

SEQ ID NO: 721007 - DNA, 25 bp, Artificial sequence
  Synthetic oligonucleotide
gctggaggccgcttccgacctgggc

SEQ ID NO: 721008 - DNA, 25 bp, Artificial sequence
  Synthetic oligonucleotide
gagcctgctggaggccgcttccgac

SEQ ID NO: 721009 - DNA, 25 bp, Artificial sequence
  Synthetic oligonucleotide
gacccgagcctgctggaggccgctt

SEQ ID NO: 721010 - DNA, 25 bp, Artificial sequence
  Synthetic oligonucleotide
aagcacgacccgagcctgctggagg

SEQ ID NO: 721011 - DNA, 25 bp, Artificial sequence
  Synthetic oligonucleotide
tggtgaagcacgacccgagcctgct

SEQ ID NO: 721012 - DNA, 25 bp, Artificial sequence
  Synthetic oligonucleotide
gtgggcgagttcgtcatcccggaac

SEQ ID NO: 721013 - DNA, 25 bp, Artificial sequence
  Synthetic oligonucleotide
tctacgccaacctggtgaagcacga

SEQ ID NO: 721014 - DNA, 25 bp, Artificial sequence
  Synthetic oligonucleotide
ctgggcgcgcgtaacttcaccagct

SEQ ID NO: 721015 - DNA, 25 bp, Artificial sequence
  Synthetic oligonucleotide
atgatcctgccgctctacgccaacc

SEQ ID NO: 721016 - DNA, 25 bp, Artificial sequence
  Synthetic oligonucleotide
ccgttcatgatcctgccgctctacg

SEQ ID NO: 721017 - DNA, 25 bp, Artificial sequence
  Synthetic oligonucleotide
tacctgccgttcatgatcctgccgc

SEQ ID NO: 721018 - DNA, 25 bp, Artificial sequence
  Synthetic oligonucleotide
tattcctacctgccgttcatgatcc

SEQ ID NO: 721019 - DNA, 25 bp, Artificial sequence
  Synthetic oligonucleotide
atcgtctattcctacctgccgttca

SEQ ID NO: 721020 - DNA, 25 bp, Artificial sequence
  Synthetic oligonucleotide
atcggcatcgtctattcctacctgc

SEQ ID NO: 721021 - DNA, 25 bp, Artificial sequence
  Synthetic oligonucleotide
ccaacctggtgaagcacgacccgag

SEQ ID NO: 721022 - DNA, 25 bp, Artificial sequence
  Synthetic oligonucleotide
accgtgccgctgtcgaagaacggca

SEQ ID NO: 721023 - DNA, 25 bp, Artificial sequence
  Synthetic oligonucleotide
tcgccatcgtgctgaagatcagcct

SEQ ID NO: 721024 - DNA, 25 bp, Artificial sequence
  Synthetic oligonucleotide
gctggtgttcatcccggcggtgggc

SEQ ID NO: 721025 - DNA, 25 bp, Artificial sequence
  Synthetic oligonucleotide
ctgcatgctggtgttcatcccggcg

SEQ ID NO: 721026 - DNA, 25 bp, Artificial sequence
  Synthetic oligonucleotide
cgccggctgcatgctggtgttcatc

SEQ ID NO: 721027 - DNA, 25 bp, Artificial sequence
  Synthetic oligonucleotide
catcatcgccggctgcatgctggtg

SEQ ID NO: 721028 - DNA, 25 bp, Artificial sequence
  Synthetic oligonucleotide
gaacggcatcatcgccggctgcatg

SEQ ID NO: 721029 - DNA, 25 bp, Artificial sequence
  Synthetic oligonucleotide
ggccgcttccgacctgggcgcgcgt

SEQ ID NO: 721030 - DNA, 25 bp, Artificial sequence
  Synthetic oligonucleotide
ccgctgtcgaagaacggcatcatcg

SEQ ID NO: 721031 - DNA, 25 bp, Artificial sequence
  Synthetic oligonucleotide
ttccgacctgggcgcgcgtaacttc

SEQ ID NO: 721032 - DNA, 25 bp, Artificial sequence
  Synthetic oligonucleotide
aagatcaccgtgccgctgtcgaaga

SEQ ID NO: 721033 - DNA, 25 bp, Artificial sequence
  Synthetic oligonucleotide
ttctggaagatcaccgtgccgctgt

SEQ ID NO: 721034 - DNA, 25 bp, Artificial sequence
  Synthetic oligonucleotide
accagcttctggaagatcaccgtgc

SEQ ID NO: 721035 - DNA, 25 bp, Artificial sequence
  Synthetic oligonucleotide
aacttcaccagcttctggaagatca

SEQ ID NO: 721036 - DNA, 25 bp, Artificial sequence
  Synthetic oligonucleotide
gcgcgtaacttcaccagcttctgga

SEQ ID NO: 721037 - DNA, 25 bp, Artificial sequence
  Synthetic oligonucleotide
ccggcggtgggcgagttcgtcatcc

SEQ ID NO: 721038 - DNA, 25 bp, Artificial sequence
  Synthetic oligonucleotide
tcgaagaacggcatcatcgccggct

SEQ ID NO: 721039 - DNA, 25 bp, Artificial sequence
  Synthetic oligonucleotide
cgagaccccggcgagccgcctggtc

SEQ ID NO: 721040 - DNA, 25 bp, Artificial sequence
  Synthetic oligonucleotide
tgaagatcagcctggcggaagcgga

SEQ ID NO: 721041 - DNA, 25 bp, Artificial sequence
  Synthetic oligonucleotide
ggcaacgtcaacctgttcgacggcg

SEQ ID NO: 721042 - DNA, 25 bp, Artificial sequence
  Synthetic oligonucleotide
ttcatcggcaacgtcaacctgttcg

SEQ ID NO: 721043 - DNA, 25 bp, Artificial sequence
  Synthetic oligonucleotide
tgcgagttcatcggcaacgtcaacc

SEQ ID NO: 721044 - DNA, 25 bp, Artificial sequence
  Synthetic oligonucleotide
ctggtctgcgagttcatcggcaacg

SEQ ID NO: 721045 - DNA, 25 bp, Artificial sequence
  Synthetic oligonucleotide
ctgttcgacggcgtgctggtggagg

SEQ ID NO: 721046 - DNA, 25 bp, Artificial sequence
  Synthetic oligonucleotide
ccggcgagccgcctggtctgcgagt

SEQ ID NO: 721047 - DNA, 25 bp, Artificial sequence
  Synthetic oligonucleotide
gacggcgtgctggtggaggacgtgc

SEQ ID NO: 721048 - DNA, 25 bp, Artificial sequence
  Synthetic oligonucleotide
acatctacgagaccccggcgagccg

SEQ ID NO: 721049 - DNA, 25 bp, Artificial sequence
  Synthetic oligonucleotide
gatggacatctacgagaccccggcg

SEQ ID NO: 721050 - DNA, 25 bp, Artificial sequence
  Synthetic oligonucleotide
cagcccgatggacatctacgagacc

SEQ ID NO: 721051 - DNA, 25 bp, Artificial sequence
  Synthetic oligonucleotide
gatcggcagcccgatggacatctac

SEQ ID NO: 721052 - DNA, 25 bp, Artificial sequence
  Synthetic oligonucleotide
tcgagcagatcggcagcccgatgga

SEQ ID NO: 721053 - DNA, 25 bp, Artificial sequence
  Synthetic oligonucleotide
gctgcatcgagcagatcggcagccc

SEQ ID NO: 721054 - DNA, 25 bp, Artificial sequence
  Synthetic oligonucleotide
agccgcctggtctgcgagttcatcg

SEQ ID NO: 721055 - DNA, 25 bp, Artificial sequence
  Synthetic oligonucleotide
cctgcccgcagctggagaacccgat

SEQ ID NO: 721056 - DNA, 25 bp, Artificial sequence
  Synthetic oligonucleotide
atcagcacccgcgccgaggacaagc

SEQ ID NO: 721057 - DNA, 25 bp, Artificial sequence
  Synthetic oligonucleotide
cacggcatcagcacccgcgccgagg

SEQ ID NO: 721058 - DNA, 25 bp, Artificial sequence
  Synthetic oligonucleotide
atcggccacggcatcagcacccgcg

SEQ ID NO: 721059 - DNA, 25 bp, Artificial sequence
  Synthetic oligonucleotide
atctacatcggccacggcatcagca

SEQ ID NO: 721060 - DNA, 25 bp, Artificial sequence
  Synthetic oligonucleotide
acccgatctacatcggccacggcat

SEQ ID NO: 721061 - DNA, 25 bp, Artificial sequence
  Synthetic oligonucleotide
gtcaacctgttcgacggcgtgctgg

SEQ ID NO: 721062 - DNA, 25 bp, Artificial sequence
  Synthetic oligonucleotide
cgcagctggagaacccgatctacat

SEQ ID NO: 721063 - DNA, 25 bp, Artificial sequence
  Synthetic oligonucleotide
tcgccatcatgcacctgggctgcat

SEQ ID NO: 721064 - DNA, 25 bp, Artificial sequence
  Synthetic oligonucleotide
tgatcgcctgcccgcagctggagaa

SEQ ID NO: 721065 - DNA, 25 bp, Artificial sequence
  Synthetic oligonucleotide
atgcggtgatcgcctgcccgcagct

SEQ ID NO: 721066 - DNA, 25 bp, Artificial sequence
  Synthetic oligonucleotide
caggaccatgcggtgatcgcctgcc

SEQ ID NO: 721067 - DNA, 25 bp, Artificial sequence
  Synthetic oligonucleotide
gacgtgcaggaccatgcggtgatcg

SEQ ID NO: 721068 - DNA, 25 bp, Artificial sequence
  Synthetic oligonucleotide
gtggaggacgtgcaggaccatgcgg

SEQ ID NO: 721069 - DNA, 25 bp, Artificial sequence
  Synthetic oligonucleotide
gtgctggtggaggacgtgcaggacc

SEQ ID NO: 721070 - DNA, 25 bp, Artificial sequence
  Synthetic oligonucleotide
tggagaacccgatctacatcggcca

SEQ ID NO: 721071 - DNA, 25 bp, Artificial sequence
  Synthetic oligonucleotide
tgctcgacgagccgatgggcgcgct

SEQ ID NO: 721072 - DNA, 25 bp, Artificial sequence
  Synthetic oligonucleotide
cgcagatgcaactggaactggtgga

SEQ ID NO: 721073 - DNA, 25 bp, Artificial sequence
  Synthetic oligonucleotide
tgcgctcgcagatgcaactggaact

SEQ ID NO: 721074 - DNA, 25 bp, Artificial sequence
  Synthetic oligonucleotide
agaagctgcgctcgcagatgcaact

SEQ ID NO: 721075 - DNA, 25 bp, Artificial sequence
  Synthetic oligonucleotide
tggacaagaagctgcgctcgcagat

SEQ ID NO: 721076 - DNA, 25 bp, Artificial sequence
  Synthetic oligonucleotide
gcgcgctggacaagaagctgcgctc

SEQ ID NO: 721077 - DNA, 25 bp, Artificial sequence
  Synthetic oligonucleotide
acctgggctgcatcgagcagatcgg

SEQ ID NO: 721078 - DNA, 25 bp, Artificial sequence
  Synthetic oligonucleotide
acgagccgatgggcgcgctggacaa

SEQ ID NO: 721079 - DNA, 25 bp, Artificial sequence
  Synthetic oligonucleotide
ctggtggagatcatcgagcgcgtcg

SEQ ID NO: 721080 - DNA, 25 bp, Artificial sequence
  Synthetic oligonucleotide
tgctgctgctcgacgagccgatggg

SEQ ID NO: 721081 - DNA, 25 bp, Artificial sequence
  Synthetic oligonucleotide
ccgaagctgctgctgctcgacgagc

SEQ ID NO: 721082 - DNA, 25 bp, Artificial sequence
  Synthetic oligonucleotide
aagcggccgaagctgctgctgctcg

SEQ ID NO: 721083 - DNA, 25 bp, Artificial sequence
  Synthetic oligonucleotide
ctggccaagcggccgaagctgctgc

SEQ ID NO: 721084 - DNA, 25 bp, Artificial sequence
  Synthetic oligonucleotide
gttcgctggccaagcggccgaagct

SEQ ID NO: 721085 - DNA, 25 bp, Artificial sequence
  Synthetic oligonucleotide
tcagcctggcggaagcggacgtggc

SEQ ID NO: 721086 - DNA, 25 bp, Artificial sequence
  Synthetic oligonucleotide
cgatgggcgcgctggacaagaagct

SEQ ID NO: 721087 - DNA, 25 bp, Artificial sequence
  Synthetic oligonucleotide
tgatggtgacccacgaccaggaaga

SEQ ID NO: 721088 - DNA, 25 bp, Artificial sequence
  Synthetic oligonucleotide
acaagcgcatcacctacgcgctgcg

SEQ ID NO: 721089 - DNA, 25 bp, Artificial sequence
  Synthetic oligonucleotide
agcgcatcgccatcatgcacctggg

SEQ ID NO: 721090 - DNA, 25 bp, Artificial sequence
  Synthetic oligonucleotide
tggcccagcgcatcgccatcatgca

SEQ ID NO: 721091 - DNA, 25 bp, Artificial sequence
  Synthetic oligonucleotide
tgaccatggcccagcgcatcgccat

SEQ ID NO: 721092 - DNA, 25 bp, Artificial sequence
  Synthetic oligonucleotide
aggccatgaccatggcccagcgcat

SEQ ID NO: 721093 - DNA, 25 bp, Artificial sequence
  Synthetic oligonucleotide
aggaagaggccatgaccatggccca

SEQ ID NO: 721094 - DNA, 25 bp, Artificial sequence
  Synthetic oligonucleotide
tgcaactggaactggtggagatcat

SEQ ID NO: 721095 - DNA, 25 bp, Artificial sequence
  Synthetic oligonucleotide
tgacccacgaccaggaagaggccat

SEQ ID NO: 721096 - DNA, 25 bp, Artificial sequence
  Synthetic oligonucleotide
ctggaactggtggagatcatcgagc

SEQ ID NO: 721097 - DNA, 25 bp, Artificial sequence
  Synthetic oligonucleotide
cctgcgtgatggtgacccacgacca

SEQ ID NO: 721098 - DNA, 25 bp, Artificial sequence
  Synthetic oligonucleotide
gcgtgacctgcgtgatggtgaccca

SEQ ID NO: 721099 - DNA, 25 bp, Artificial sequence
  Synthetic oligonucleotide
cgcgtcggcgtgacctgcgtgatgg

SEQ ID NO: 721100 - DNA, 25 bp, Artificial sequence
  Synthetic oligonucleotide
atcgagcgcgtcggcgtgacctgcg

SEQ ID NO: 721101 - DNA, 25 bp, Artificial sequence
  Synthetic oligonucleotide
gagatcatcgagcgcgtcggcgtga

SEQ ID NO: 721102 - DNA, 25 bp, Artificial sequence
  Synthetic oligonucleotide
tcatgcacctgggctgcatcgagca

SEQ ID NO: 721103 - DNA, 25 bp, Artificial sequence
  Synthetic oligonucleotide
acgaccaggaagaggccatgaccat

SEQ ID NO: 721104 - DNA, 25 bp, Artificial sequence
  Synthetic oligonucleotide
acatcagctggtacgacgacagcgg

SEQ ID NO: 721105 - DNA, 25 bp, Artificial sequence
  Synthetic oligonucleotide
gaaattcgccaacagcctgaaaaag

SEQ ID NO: 721106 - DNA, 25 bp, Artificial sequence
  Synthetic oligonucleotide
agtcatgaaattcgccaacagcctg

SEQ ID NO: 721107 - DNA, 25 bp, Artificial sequence
  Synthetic oligonucleotide
tactgcagtcatgaaattcgccaac

SEQ ID NO: 721108 - DNA, 25 bp, Artificial sequence
  Synthetic oligonucleotide
gcgtggtactgcagtcatgaaattc

SEQ ID NO: 721109 - DNA, 25 bp, Artificial sequence
  Synthetic oligonucleotide
acagcggcgtggtactgcagtcatg

SEQ ID NO: 721110 - DNA, 25 bp, Artificial sequence
  Synthetic oligonucleotide
cgagcgccacgtcgcccggccgacc

SEQ ID NO: 721111 - DNA, 25 bp, Artificial sequence
  Synthetic oligonucleotide
gctggtacgacgacagcggcgtggt

SEQ ID NO: 721112 - DNA, 25 bp, Artificial sequence
  Synthetic oligonucleotide
gaaaaagcgcatgcccaccgggcgg

SEQ ID NO: 721113 - DNA, 25 bp, Artificial sequence
  Synthetic oligonucleotide
cggtgtacatcagctggtacgacga

SEQ ID NO: 721114 - DNA, 25 bp, Artificial sequence
  Synthetic oligonucleotide
accagtcggtgtacatcagctggta

SEQ ID NO: 721115 - DNA, 25 bp, Artificial sequence
  Synthetic oligonucleotide
cctgggaccagtcggtgtacatcag

SEQ ID NO: 721116 - DNA, 25 bp, Artificial sequence
  Synthetic oligonucleotide
ggccgacctgggaccagtcggtgta

SEQ ID NO: 721117 - DNA, 25 bp, Artificial sequence
  Synthetic oligonucleotide
tcgcccggccgacctgggaccagtc

SEQ ID NO: 721118 - DNA, 25 bp, Artificial sequence
  Synthetic oligonucleotide
acccgcgccgaggacaagcgcatca

SEQ ID NO: 721119 - DNA, 25 bp, Artificial sequence
  Synthetic oligonucleotide
acgacgacagcggcgtggtactgca

SEQ ID NO: 721120 - DNA, 25 bp, Artificial sequence
  Synthetic oligonucleotide
tcggggtgccgttcctgtggctctt

SEQ ID NO: 721121 - DNA, 25 bp, Artificial sequence
  Synthetic oligonucleotide
ggccctggctcgttcgctggccaag

SEQ ID NO: 721122 - DNA, 25 bp, Artificial sequence
  Synthetic oligonucleotide
gcccttcgccatcgtgctgaagatc

SEQ ID NO: 721123 - DNA, 25 bp, Artificial sequence
  Synthetic oligonucleotide
cctgctgcccttcgccatcgtgctg

SEQ ID NO: 721124 - DNA, 25 bp, Artificial sequence
  Synthetic oligonucleotide
gttcttcctgctgcccttcgccatc

SEQ ID NO: 721125 - DNA, 25 bp, Artificial sequence
  Synthetic oligonucleotide
ttcctgttcttcctgctgcccttcg

SEQ ID NO: 721126 - DNA, 25 bp, Artificial sequence
  Synthetic oligonucleotide
tggctcttcctgttcttcctgctgc

SEQ ID NO: 721127 - DNA, 25 bp, Artificial sequence
  Synthetic oligonucleotide
gccaacagcctgaaaaagcgcatgc

SEQ ID NO: 721128 - DNA, 25 bp, Artificial sequence
  Synthetic oligonucleotide
tgccgttcctgtggctcttcctgtt

SEQ ID NO: 721129 - DNA, 25 bp, Artificial sequence
  Synthetic oligonucleotide
agcctgaaaaagcgcatgcccaccg

SEQ ID NO: 721130 - DNA, 25 bp, Artificial sequence
  Synthetic oligonucleotide
cggtcatcggggtgccgttcctgtg

SEQ ID NO: 721131 - DNA, 25 bp, Artificial sequence
  Synthetic oligonucleotide
ggcatgcggtcatcggggtgccgtt

SEQ ID NO: 721132 - DNA, 25 bp, Artificial sequence
  Synthetic oligonucleotide
ccgggcggcatgcggtcatcggggt

SEQ ID NO: 721133 - DNA, 25 bp, Artificial sequence
  Synthetic oligonucleotide
tgcccaccgggcggcatgcggtcat

SEQ ID NO: 721134 - DNA, 25 bp, Artificial sequence
  Synthetic oligonucleotide
agcgcatgcccaccgggcggcatgc

SEQ ID NO: 721135 - DNA, 25 bp, Artificial sequence
  Synthetic oligonucleotide
aacgccgagcgccacgtcgcccggc

SEQ ID NO: 721136 - DNA, 25 bp, Artificial sequence
  Synthetic oligonucleotide
tcctgtggctcttcctgttcttcct

SEQ ID NO: 721137 - DNA, 25 bp, Artificial sequence
  Synthetic oligonucleotide
tgatgatcagcgcgcagaagccgga

SEQ ID NO: 721138 - DNA, 25 bp, Artificial sequence
  Synthetic oligonucleotide
ggcacaactgggcccagggcaccgt

SEQ ID NO: 721139 - DNA, 25 bp, Artificial sequence
  Synthetic oligonucleotide
acgccgggcacaactgggcccaggg

SEQ ID NO: 721140 - DNA, 25 bp, Artificial sequence
  Synthetic oligonucleotide
tggaacacgccgggcacaactgggc

SEQ ID NO: 721141 - DNA, 25 bp, Artificial sequence
  Synthetic oligonucleotide
acaacctggaacacgccgggcacaa

SEQ ID NO: 721142 - DNA, 25 bp, Artificial sequence
  Synthetic oligonucleotide
agccggacaacctggaacacgccgg

SEQ ID NO: 721143 - DNA, 25 bp, Artificial sequence
  Synthetic oligonucleotide
gccacgtcgcccggccgacctggga

SEQ ID NO: 721144 - DNA, 25 bp, Artificial sequence
  Synthetic oligonucleotide
tcagcgcgcagaagccggacaacct

SEQ ID NO: 721145 - DNA, 25 bp, Artificial sequence
  Synthetic oligonucleotide
gcaccgtctacgacatcgcctacct

SEQ ID NO: 721146 - DNA, 25 bp, Artificial sequence
  Synthetic oligonucleotide
agaaagtgatgatcagcgcgcagaa

SEQ ID NO: 721147 - DNA, 25 bp, Artificial sequence
  Synthetic oligonucleotide
ggccggagaaagtgatgatcagcgc

SEQ ID NO: 721148 - DNA, 25 bp, Artificial sequence
  Synthetic oligonucleotide
cgctgcggccggagaaagtgatgat

SEQ ID NO: 721149 - DNA, 25 bp, Artificial sequence
  Synthetic oligonucleotide
cctacgcgctgcggccggagaaagt

SEQ ID NO: 721150 - DNA, 25 bp, Artificial sequence
  Synthetic oligonucleotide
gcatcacctacgcgctgcggccgga

SEQ ID NO: 721151 - DNA, 25 bp, Artificial sequence
  Synthetic oligonucleotide
tcgtgctgaagatcagcctggcgga

SEQ ID NO: 721152 - DNA, 25 bp, Artificial sequence
  Synthetic oligonucleotide
cgcagaagccggacaacctggaaca

SEQ ID NO: 721153 - DNA, 25 bp, Artificial sequence
  Synthetic oligonucleotide
cggtgtactacatcaagctggcgtc

SEQ ID NO: 721154 - DNA, 25 bp, Artificial sequence
  Synthetic oligonucleotide
atggccaacgccgagcgccacgtcg

SEQ ID NO: 721155 - DNA, 25 bp, Artificial sequence
  Synthetic oligonucleotide
gccttcatggccaacgccgagcgcc

SEQ ID NO: 721156 - DNA, 25 bp, Artificial sequence
  Synthetic oligonucleotide
tccaggccttcatggccaacgccga

SEQ ID NO: 721157 - DNA, 25 bp, Artificial sequence
  Synthetic oligonucleotide
tgatcgtccaggccttcatggccaa

SEQ ID NO: 721158 - DNA, 25 bp, Artificial sequence
  Synthetic oligonucleotide
ccgggatgatcgtccaggccttcat

SEQ ID NO: 721159 - DNA, 25 bp, Artificial sequence
  Synthetic oligonucleotide
tggcgtccgggatgatcgtccaggc

SEQ ID NO: 721160 - DNA, 25 bp, Artificial sequence
  Synthetic oligonucleotide
actgggcccagggcaccgtctacga

SEQ ID NO: 721161 - DNA, 25 bp, Artificial sequence
  Synthetic oligonucleotide
actacatcaagctggcgtccgggat

SEQ ID NO: 721162 - DNA, 25 bp, Artificial sequence
  Synthetic oligonucleotide
cccagggcaccgtctacgacatcgc

SEQ ID NO: 721163 - DNA, 25 bp, Artificial sequence
  Synthetic oligonucleotide
gccactcggtgtactacatcaagct

SEQ ID NO: 721164 - DNA, 25 bp, Artificial sequence
  Synthetic oligonucleotide
ttggcggccactcggtgtactacat

SEQ ID NO: 721165 - DNA, 25 bp, Artificial sequence
  Synthetic oligonucleotide
cctaccttggcggccactcggtgta

SEQ ID NO: 721166 - DNA, 25 bp, Artificial sequence
  Synthetic oligonucleotide
acatcgcctaccttggcggccactc

SEQ ID NO: 721167 - DNA, 25 bp, Artificial sequence
  Synthetic oligonucleotide
tctacgacatcgcctaccttggcgg

SEQ ID NO: 721168 - DNA, 25 bp, Artificial sequence
  Synthetic oligonucleotide
ccgaggacaagcgcatcacctacgc

SEQ ID NO: 721169 - DNA, 25 bp, Artificial sequence
  Synthetic oligonucleotide
tcaagctggcgtccgggatgatcgt

SEQ ID NO: 721170 - DNA, 25 bp, Artificial sequence
  Synthetic oligonucleotide
gagtggttcggcagccagtactacg

SEQ ID NO: 721171 - DNA, 25 bp, Artificial sequence
  Synthetic oligonucleotide
cacggcttcacctattccggtcacc

SEQ ID NO: 721172 - DNA, 25 bp, Artificial sequence
  Synthetic oligonucleotide
acctgatgccgatcgccaagggcct

SEQ ID NO: 721173 - DNA, 25 bp, Artificial sequence
  Synthetic oligonucleotide
ccccggacctgatgccgatcgccaa

SEQ ID NO: 721174 - DNA, 25 bp, Artificial sequence
  Synthetic oligonucleotide
gcaacgccccggacctgatgccgat

SEQ ID NO: 721175 - DNA, 25 bp, Artificial sequence
  Synthetic oligonucleotide
actacggcaacgccccggacctgat

SEQ ID NO: 721176 - DNA, 25 bp, Artificial sequence
  Synthetic oligonucleotide
tcgccaagggcctcacctccggcta

SEQ ID NO: 721177 - DNA, 25 bp, Artificial sequence
  Synthetic oligonucleotide
ttcggcagccagtactacggcaacg

SEQ ID NO: 721178 - DNA, 25 bp, Artificial sequence
  Synthetic oligonucleotide
agggcctcacctccggctacatccc

SEQ ID NO: 721179 - DNA, 25 bp, Artificial sequence
  Synthetic oligonucleotide
accggcgagtggttcggcagccagt

SEQ ID NO: 721180 - DNA, 25 bp, Artificial sequence
  Synthetic oligonucleotide
ggccgtaccggcgagtggttcggca

SEQ ID NO: 721181 - DNA, 25 bp, Artificial sequence
  Synthetic oligonucleotide
tctgcggcttcggccgtaccggcga

SEQ ID NO: 721182 - DNA, 25 bp, Artificial sequence
  Synthetic oligonucleotide
aagtgatctgcggcttcggccgtac

SEQ ID NO: 721183 - DNA, 25 bp, Artificial sequence
  Synthetic oligonucleotide
ccgacgaagtgatctgcggcttcgg

SEQ ID NO: 721184 - DNA, 25 bp, Artificial sequence
  Synthetic oligonucleotide
tcatcgccgacgaagtgatctgcgg

SEQ ID NO: 721185 - DNA, 25 bp, Artificial sequence
  Synthetic oligonucleotide
agccagtactacggcaacgccccgg

SEQ ID NO: 721186 - DNA, 25 bp, Artificial sequence
  Synthetic oligonucleotide
tgcgcgacgagatcgtcgaagtgct

SEQ ID NO: 721187 - DNA, 25 bp, Artificial sequence
  Synthetic oligonucleotide
cctggcttgagtccctgagcggact

SEQ ID NO: 721188 - DNA, 25 bp, Artificial sequence
  Synthetic oligonucleotide
gcgagttctaccacggcttcaccta

SEQ ID NO: 721189 - DNA, 25 bp, Artificial sequence
  Synthetic oligonucleotide
agggcggcgagttctaccacggctt

SEQ ID NO: 721190 - DNA, 25 bp, Artificial sequence
  Synthetic oligonucleotide
tcaaccagggcggcgagttctacca

SEQ ID NO: 721191 - DNA, 25 bp, Artificial sequence
  Synthetic oligonucleotide
gaagtgctcaaccagggcggcgagt

SEQ ID NO: 721192 - DNA, 25 bp, Artificial sequence
  Synthetic oligonucleotide
tgccgatcgccaagggcctcacctc

SEQ ID NO: 721193 - DNA, 25 bp, Artificial sequence
  Synthetic oligonucleotide
acgagatcgtcgaagtgctcaacca

SEQ ID NO: 721194 - DNA, 25 bp, Artificial sequence
  Synthetic oligonucleotide
ccaagtacgacatcctgttcatcgc

SEQ ID NO: 721195 - DNA, 25 bp, Artificial sequence
  Synthetic oligonucleotide
tggtggtgcgcgacgagatcgtcga

SEQ ID NO: 721196 - DNA, 25 bp, Artificial sequence
  Synthetic oligonucleotide
gcggggtggtggtgcgcgacgagat

SEQ ID NO: 721197 - DNA, 25 bp, Artificial sequence
  Synthetic oligonucleotide
ccatgggcggggtggtggtgcgcga

SEQ ID NO: 721198 - DNA, 25 bp, Artificial sequence
  Synthetic oligonucleotide
acatccccatgggcggggtggtggt

SEQ ID NO: 721199 - DNA, 25 bp, Artificial sequence
  Synthetic oligonucleotide
ccggctacatccccatgggcggggt

SEQ ID NO: 721200 - DNA, 25 bp, Artificial sequence
  Synthetic oligonucleotide
tcacctccggctacatccccatggg

SEQ ID NO: 721201 - DNA, 25 bp, Artificial sequence
  Synthetic oligonucleotide
tcgtcgaagtgctcaaccagggcgg

SEQ ID NO: 721202 - DNA, 25 bp, Artificial sequence
  Synthetic oligonucleotide
cggcgtctgggccgccgagcagttg

SEQ ID NO: 721203 - DNA, 25 bp, Artificial sequence
  Synthetic oligonucleotide
ggcgaggaaaacgtcgccgccttca

SEQ ID NO: 721204 - DNA, 25 bp, Artificial sequence
  Synthetic oligonucleotide
ctcgaagtgggcgaggaaaacgtcg

SEQ ID NO: 721205 - DNA, 25 bp, Artificial sequence
  Synthetic oligonucleotide
gaagattctcgaagtgggcgaggaa

SEQ ID NO: 721206 - DNA, 25 bp, Artificial sequence
  Synthetic oligonucleotide
ggagaagaagattctcgaagtgggc

SEQ ID NO: 721207 - DNA, 25 bp, Artificial sequence
  Synthetic oligonucleotide
gcagttggagaagaagattctcgaa

SEQ ID NO: 721208 - DNA, 25 bp, Artificial sequence
  Synthetic oligonucleotide
tcctgttcatcgccgacgaagtgat

SEQ ID NO: 721209 - DNA, 25 bp, Artificial sequence
  Synthetic oligonucleotide
ctgggccgccgagcagttggagaag

SEQ ID NO: 721210 - DNA, 25 bp, Artificial sequence
  Synthetic oligonucleotide
gccttcatcgccgagccgatccagg

SEQ ID NO: 721211 - DNA, 25 bp, Artificial sequence
  Synthetic oligonucleotide
cgagttcggcgtctgggccgccgag

SEQ ID NO: 721212 - DNA, 25 bp, Artificial sequence
  Synthetic oligonucleotide
gccggacgagttcggcgtctgggcc

SEQ ID NO: 721213 - DNA, 25 bp, Artificial sequence
  Synthetic oligonucleotide
atgtcgccggacgagttcggcgtct

SEQ ID NO: 721214 - DNA, 25 bp, Artificial sequence
  Synthetic oligonucleotide
ggcgacatgtcgccggacgagttcg

SEQ ID NO: 721215 - DNA, 25 bp, Artificial sequence
  Synthetic oligonucleotide
gagggcggcgacatgtcgccggacg

SEQ ID NO: 721216 - DNA, 25 bp, Artificial sequence
  Synthetic oligonucleotide
tacggcgagggcggcgacatgtcgc

SEQ ID NO: 721217 - DNA, 25 bp, Artificial sequence
  Synthetic oligonucleotide
cgccgagcagttggagaagaagatt

SEQ ID NO: 721218 - DNA, 25 bp, Artificial sequence
  Synthetic oligonucleotide
gtgatcgtcccgccggacacctact

SEQ ID NO: 721219 - DNA, 25 bp, Artificial sequence
  Synthetic oligonucleotide
tcacctattccggtcacccggtggc

SEQ ID NO: 721220 - DNA, 25 bp, Artificial sequence
  Synthetic oligonucleotide
tcctcgccaagtacgacatcctgtt

SEQ ID NO: 721221 - DNA, 25 bp, Artificial sequence
  Synthetic oligonucleotide
gcgagatcctcgccaagtacgacat

SEQ ID NO: 721222 - DNA, 25 bp, Artificial sequence
  Synthetic oligonucleotide
aagatccgcgagatcctcgccaagt

SEQ ID NO: 721223 - DNA, 25 bp, Artificial sequence
  Synthetic oligonucleotide
tggccgaagatccgcgagatcctcg

SEQ ID NO: 721224 - DNA, 25 bp, Artificial sequence
  Synthetic oligonucleotide
acctactggccgaagatccgcgaga

SEQ ID NO: 721225 - DNA, 25 bp, Artificial sequence
  Synthetic oligonucleotide
ggaaaacgtcgccgccttcatcgcc

SEQ ID NO: 721226 - DNA, 25 bp, Artificial sequence
  Synthetic oligonucleotide
gtcccgccggacacctactggccga

SEQ ID NO: 721227 - DNA, 25 bp, Artificial sequence
  Synthetic oligonucleotide
cgtcgccgccttcatcgccgagccg

SEQ ID NO: 721228 - DNA, 25 bp, Artificial sequence
  Synthetic oligonucleotide
ggcggcgtgatcgtcccgccggaca

SEQ ID NO: 721229 - DNA, 25 bp, Artificial sequence
  Synthetic oligonucleotide
ggcgccggcggcgtgatcgtcccgc

SEQ ID NO: 721230 - DNA, 25 bp, Artificial sequence
  Synthetic oligonucleotide
atccagggcgccggcggcgtgatcg

SEQ ID NO: 721231 - DNA, 25 bp, Artificial sequence
  Synthetic oligonucleotide
gagccgatccagggcgccggcggcg

SEQ ID NO: 721232 - DNA, 25 bp, Artificial sequence
  Synthetic oligonucleotide
atcgccgagccgatccagggcgccg

SEQ ID NO: 721233 - DNA, 25 bp, Artificial sequence
  Synthetic oligonucleotide
acgacatcctgttcatcgccgacga

SEQ ID NO: 721234 - DNA, 25 bp, Artificial sequence
  Synthetic oligonucleotide
gccggacacctactggccgaagatc

SEQ ID NO: 721235 - DNA, 25 bp, Artificial sequence
  Synthetic oligonucleotide
gaacattgtttccgcaacggtttga

SEQ ID NO: 721236 - DNA, 25 bp, Artificial sequence
  Synthetic oligonucleotide
tctaccacggcttcacctattccgg

SEQ ID NO: 721237 - DNA, 25 bp, Artificial sequence
  Synthetic oligonucleotide
gtgggcgacactatgattatctcgc

SEQ ID NO: 721238 - DNA, 25 bp, Artificial sequence
  Synthetic oligonucleotide
cgcgcggtgggcgacactatgatta

SEQ ID NO: 721239 - DNA, 25 bp, Artificial sequence
  Synthetic oligonucleotide
atcatgcgcgcggtgggcgacacta

SEQ ID NO: 721240 - DNA, 25 bp, Artificial sequence
  Synthetic oligonucleotide
cggtttgatcatgcgcgcggtgggc

SEQ ID NO: 721241 - DNA, 25 bp, Artificial sequence
  Synthetic oligonucleotide
atgattatctcgccgccgctggtga

SEQ ID NO: 721242 - DNA, 25 bp, Artificial sequence
  Synthetic oligonucleotide
tgtttccgcaacggtttgatcatgc

SEQ ID NO: 721243 - DNA, 25 bp, Artificial sequence
  Synthetic oligonucleotide
atctcgccgccgctggtgatcgatc

SEQ ID NO: 721244 - DNA, 25 bp, Artificial sequence
  Synthetic oligonucleotide
tgtgccgggaacattgtttccgcaa

SEQ ID NO: 721245 - DNA, 25 bp, Artificial sequence
  Synthetic oligonucleotide
ggatgctgtgccgggaacattgttt

SEQ ID NO: 721246 - DNA, 25 bp, Artificial sequence
  Synthetic oligonucleotide
ggcgtcgggatgctgtgccgggaac

SEQ ID NO: 721247 - DNA, 25 bp, Artificial sequence
  Synthetic oligonucleotide
gacaagggcgtcgggatgctgtgcc

SEQ ID NO: 721248 - DNA, 25 bp, Artificial sequence
  Synthetic oligonucleotide
ttcaccgacaagggcgtcgggatgc

SEQ ID NO: 721249 - DNA, 25 bp, Artificial sequence
  Synthetic oligonucleotide
agcgtttcaccgacaagggcgtcgg

SEQ ID NO: 721250 - DNA, 25 bp, Artificial sequence
  Synthetic oligonucleotide
cgcaacggtttgatcatgcgcgcgg

SEQ ID NO: 721251 - DNA, 25 bp, Artificial sequence
  Synthetic oligonucleotide
tgatcaccctggcgcgcaagtgcct

SEQ ID NO: 721252 - DNA, 25 bp, Artificial sequence
  Synthetic oligonucleotide
gccgtcctggcttgagtccctgagc

SEQ ID NO: 721253 - DNA, 25 bp, Artificial sequence
  Synthetic oligonucleotide
gccgccgccgtcctggcttgagtcc

SEQ ID NO: 721254 - DNA, 25 bp, Artificial sequence
  Synthetic oligonucleotide
agaccgccgccgccgtcctggcttg

SEQ ID NO: 721255 - DNA, 25 bp, Artificial sequence
  Synthetic oligonucleotide
tcgatcagaccgccgccgccgtcct

SEQ ID NO: 721256 - DNA, 25 bp, Artificial sequence
  Synthetic oligonucleotide
aagtgcctcgatcagaccgccgccg

SEQ ID NO: 721257 - DNA, 25 bp, Artificial sequence
  Synthetic oligonucleotide
gacactatgattatctcgccgccgc

SEQ ID NO: 721258 - DNA, 25 bp, Artificial sequence
  Synthetic oligonucleotide
ccctggcgcgcaagtgcctcgatca

SEQ ID NO: 721259 - DNA, 25 bp, Artificial sequence
  Synthetic oligonucleotide
agaacaagaagacccgcgagcgttt

SEQ ID NO: 721260 - DNA, 25 bp, Artificial sequence
  Synthetic oligonucleotide
atgagttgatcaccctggcgcgcaa

SEQ ID NO: 721261 - DNA, 25 bp, Artificial sequence
  Synthetic oligonucleotide
agatcgatgagttgatcaccctggc

SEQ ID NO: 721262 - DNA, 25 bp, Artificial sequence
  Synthetic oligonucleotide
cgtcgcagatcgatgagttgatcac

SEQ ID NO: 721263 - DNA, 25 bp, Artificial sequence
  Synthetic oligonucleotide
tcgatccgtcgcagatcgatgagtt

SEQ ID NO: 721264 - DNA, 25 bp, Artificial sequence
  Synthetic oligonucleotide
tggtgatcgatccgtcgcagatcga

SEQ ID NO: 721265 - DNA, 25 bp, Artificial sequence
  Synthetic oligonucleotide
cgccgctggtgatcgatccgtcgca

SEQ ID NO: 721266 - DNA, 25 bp, Artificial sequence
  Synthetic oligonucleotide
gcgcgcaagtgcctcgatcagaccg

SEQ ID NO: 721267 - DNA, 25 bp, Artificial sequence
  Synthetic oligonucleotide
catccgcatcctgcgcgaagagaag

SEQ ID NO: 721268 - DNA, 25 bp, Artificial sequence
  Synthetic oligonucleotide
aaacggcaccgtatttgcagaaacg

SEQ ID NO: 721269 - DNA, 25 bp, Artificial sequence
  Synthetic oligonucleotide
aggcggaaacggcaccgtatttgca

SEQ ID NO: 721270 - DNA, 25 bp, Artificial sequence
  Synthetic oligonucleotide
tcgagaaggtgaaggcggaaacggc

SEQ ID NO: 721271 - DNA, 25 bp, Artificial sequence
  Synthetic oligonucleotide
agatcatcgagaaggtgaaggcgga

SEQ ID NO: 721272 - DNA, 25 bp, Artificial sequence
  Synthetic oligonucleotide
aagagaagatcatcgagaaggtgaa

SEQ ID NO: 721273 - DNA, 25 bp, Artificial sequence
  Synthetic oligonucleotide
cccgcgagcgtttcaccgacaaggg

SEQ ID NO: 721274 - DNA, 25 bp, Artificial sequence
  Synthetic oligonucleotide
catcctgcgcgaagagaagatcatc

SEQ ID NO: 721275 - DNA, 25 bp, Artificial sequence
  Synthetic oligonucleotide
gaaacgctggcaggagctggccgac

SEQ ID NO: 721276 - DNA, 25 bp, Artificial sequence
  Synthetic oligonucleotide
ggagaacatccgcatcctgcgcgaa

SEQ ID NO: 721277 - DNA, 25 bp, Artificial sequence
  Synthetic oligonucleotide
tggccctggagaacatccgcatcct

SEQ ID NO: 721278 - DNA, 25 bp, Artificial sequence
  Synthetic oligonucleotide
ccgccgtggccctggagaacatccg

SEQ ID NO: 721279 - DNA, 25 bp, Artificial sequence
  Synthetic oligonucleotide
tggcggccgccgtggccctggagaa

SEQ ID NO: 721280 - DNA, 25 bp, Artificial sequence
  Synthetic oligonucleotide
cccggtggcggccgccgtggccctg

SEQ ID NO: 721281 - DNA, 25 bp, Artificial sequence
  Synthetic oligonucleotide
cggtcacccggtggcggccgccgtg

SEQ ID NO: 721282 - DNA, 25 bp, Artificial sequence
  Synthetic oligonucleotide
gcgcgaagagaagatcatcgagaag

SEQ ID NO: 721283 - DNA, 25 bp, Artificial sequence
  Synthetic oligonucleotide
tgggcgaagcgcgcggggtcggcat

SEQ ID NO: 721284 - DNA, 25 bp, Artificial sequence
  Synthetic oligonucleotide
atcgcccagccctactggtacggcg

SEQ ID NO: 721285 - DNA, 25 bp, Artificial sequence
  Synthetic oligonucleotide
tggtcaagaacaagaagacccgcga

SEQ ID NO: 721286 - DNA, 25 bp, Artificial sequence
  Synthetic oligonucleotide
tggagctggtcaagaacaagaagac

SEQ ID NO: 721287 - DNA, 25 bp, Artificial sequence
  Synthetic oligonucleotide
ccgccctggagctggtcaagaacaa

SEQ ID NO: 721288 - DNA, 25 bp, Artificial sequence
  Synthetic oligonucleotide
tggtcgccgccctggagctggtcaa

SEQ ID NO: 721289 - DNA, 25 bp, Artificial sequence
  Synthetic oligonucleotide
tcggcatggtcgccgccctggagct

SEQ ID NO: 721290 - DNA, 25 bp, Artificial sequence
  Synthetic oligonucleotide
caccgtatttgcagaaacgctggca

SEQ ID NO: 721291 - DNA, 25 bp, Artificial sequence
  Synthetic oligonucleotide
aagcgcgcggggtcggcatggtcgc

SEQ ID NO: 721292 - DNA, 25 bp, Artificial sequence
  Synthetic oligonucleotide
tttgcagaaacgctggcaggagctg

SEQ ID NO: 721293 - DNA, 25 bp, Artificial sequence
  Synthetic oligonucleotide
cgttggtgggcgaagcgcgcggggt

SEQ ID NO: 721294 - DNA, 25 bp, Artificial sequence
  Synthetic oligonucleotide
accacccgttggtgggcgaagcgcg

SEQ ID NO: 721295 - DNA, 25 bp, Artificial sequence
  Synthetic oligonucleotide
tggccgaccacccgttggtgggcga

SEQ ID NO: 721296 - DNA, 25 bp, Artificial sequence
  Synthetic oligonucleotide
ggagctggccgaccacccgttggtg

SEQ ID NO: 721297 - DNA, 25 bp, Artificial sequence
  Synthetic oligonucleotide
ctggcaggagctggccgaccacccg

SEQ ID NO: 721298 - DNA, 25 bp, Artificial sequence
  Synthetic oligonucleotide
agaagacccgcgagcgtttcaccga

SEQ ID NO: 721299 - DNA, 25 bp, Artificial sequence
  Synthetic oligonucleotide
gcggggtcggcatggtcgccgccct

SEQ ID NO: 721300 - DNA, 25 bp, Artificial sequence
  Synthetic oligonucleotide
atcaccaacgccaagacccgtgagt

SEQ ID NO: 721301 - DNA, 25 bp, Artificial sequence
  Synthetic oligonucleotide
tactggtacggcgagggcggcgaca

SEQ ID NO: 721302 - DNA, 25 bp, Artificial sequence
  Synthetic oligonucleotide
ccgcgaccaccatctgccgccgttc

SEQ ID NO: 721303 - DNA, 25 bp, Artificial sequence
  Synthetic oligonucleotide
gttgagccgcgaccaccatctgccg

SEQ ID NO: 721304 - DNA, 25 bp, Artificial sequence
  Synthetic oligonucleotide
gcaggcgttgagccgcgaccaccat

SEQ ID NO: 721305 - DNA, 25 bp, Artificial sequence
  Synthetic oligonucleotide
tgagtggcaggcgttgagccgcgac

SEQ ID NO: 721306 - DNA, 25 bp, Artificial sequence
  Synthetic oligonucleotide
ctgccgccgttcaccgactacaagc

SEQ ID NO: 721307 - DNA, 25 bp, Artificial sequence
  Synthetic oligonucleotide
acgccaagacccgtgagtggcaggc

SEQ ID NO: 721308 - DNA, 25 bp, Artificial sequence
  Synthetic oligonucleotide
ccgttcaccgactacaagcagttga

SEQ ID NO: 721309 - DNA, 25 bp, Artificial sequence
  Synthetic oligonucleotide
agccaaatcaccaacgccaagaccc

SEQ ID NO: 721310 - DNA, 25 bp, Artificial sequence
  Synthetic oligonucleotide
atgaacagccaaatcaccaacgcca

SEQ ID NO: 721311 - DNA, 25 bp, Artificial sequence
  Synthetic oligonucleotide
tgtgacatgaacagccaaatcacca

SEQ ID NO: 721312 - DNA, 25 bp, Artificial sequence
  Synthetic oligonucleotide
aagaggtgtgacatgaacagccaaa

SEQ ID NO: 721313 - DNA, 25 bp, Artificial sequence
  Synthetic oligonucleotide
gaatagaagaggtgtgacatgaaca

SEQ ID NO: 721314 - DNA, 25 bp, Artificial sequence
  Synthetic oligonucleotide
agtcttgaatagaagaggtgtgaca

SEQ ID NO: 721315 - DNA, 25 bp, Artificial sequence
  Synthetic oligonucleotide
agacccgtgagtggcaggcgttgag

SEQ ID NO: 721316 - DNA, 25 bp, Artificial sequence
  Synthetic oligonucleotide
atcatcaccaaggccgaaggcgtct

SEQ ID NO: 721317 - DNA, 25 bp, Artificial sequence
  Synthetic oligonucleotide
ggcaacaagatcctcgatgcgatgg

SEQ ID NO: 721318 - DNA, 25 bp, Artificial sequence
  Synthetic oligonucleotide
agcgagggcaacaagatcctcgatg

SEQ ID NO: 721319 - DNA, 25 bp, Artificial sequence
  Synthetic oligonucleotide
tgggacagcgagggcaacaagatcc

SEQ ID NO: 721320 - DNA, 25 bp, Artificial sequence
  Synthetic oligonucleotide
tatatctgggacagcgagggcaaca

SEQ ID NO: 721321 - DNA, 25 bp, Artificial sequence
  Synthetic oligonucleotide
ggcgtctatatctgggacagcgagg

SEQ ID NO: 721322 - DNA, 25 bp, Artificial sequence
  Synthetic oligonucleotide
caccatctgccgccgttcaccgact

SEQ ID NO: 721323 - DNA, 25 bp, Artificial sequence
  Synthetic oligonucleotide
accaaggccgaaggcgtctatatct

SEQ ID NO: 721324 - DNA, 25 bp, Artificial sequence
  Synthetic oligonucleotide
ggtccgccgctcccggacagtcttg

SEQ ID NO: 721325 - DNA, 25 bp, Artificial sequence
  Synthetic oligonucleotide
gcgcggatcatcaccaaggccgaag

SEQ ID NO: 721326 - DNA, 25 bp, Artificial sequence
  Synthetic oligonucleotide
aagggcgcgcggatcatcaccaagg

SEQ ID NO: 721327 - DNA, 25 bp, Artificial sequence
  Synthetic oligonucleotide
aacgagaagggcgcgcggatcatca

SEQ ID NO: 721328 - DNA, 25 bp, Artificial sequence
  Synthetic oligonucleotide
cagttgaacgagaagggcgcgcgga

SEQ ID NO: 721329 - DNA, 25 bp, Artificial sequence
  Synthetic oligonucleotide
tacaagcagttgaacgagaagggcg

SEQ ID NO: 721330 - DNA, 25 bp, Artificial sequence
  Synthetic oligonucleotide
accgactacaagcagttgaacgaga

SEQ ID NO: 721331 - DNA, 25 bp, Artificial sequence
  Synthetic oligonucleotide
gccgaaggcgtctatatctgggaca

SEQ ID NO: 721332 - DNA, 25 bp, Artificial sequence
  Synthetic oligonucleotide
actgcaagcccctcgagcagtatct

SEQ ID NO: 721333 - DNA, 25 bp, Artificial sequence
  Synthetic oligonucleotide
gcggctacgtcgcggtgaagcgtgc

SEQ ID NO: 721334 - DNA, 25 bp, Artificial sequence
  Synthetic oligonucleotide
tcatcagcggctacgtcgcggtgaa

SEQ ID NO: 721335 - DNA, 25 bp, Artificial sequence
  Synthetic oligonucleotide
gcaagttcatcagcggctacgtcgc

SEQ ID NO: 721336 - DNA, 25 bp, Artificial sequence
  Synthetic oligonucleotide
tcggcagcaagttcatcagcggcta

SEQ ID NO: 721337 - DNA, 25 bp, Artificial sequence
  Synthetic oligonucleotide
agtatctcggcagcaagttcatcag

SEQ ID NO: 721338 - DNA, 25 bp, Artificial sequence
  Synthetic oligonucleotide
cccggacagtcttgaatagaagagg

SEQ ID NO: 721339 - DNA, 25 bp, Artificial sequence
  Synthetic oligonucleotide
agcccctcgagcagtatctcggcag

SEQ ID NO: 721340 - DNA, 25 bp, Artificial sequence
  Synthetic oligonucleotide
aagcgtgcggagcacgagaatttca

SEQ ID NO: 721341 - DNA, 25 bp, Artificial sequence
  Synthetic oligonucleotide
tggagaactgcaagcccctcgagca

SEQ ID NO: 721342 - DNA, 25 bp, Artificial sequence
  Synthetic oligonucleotide
agcgcatggagaactgcaagcccct

SEQ ID NO: 721343 - DNA, 25 bp, Artificial sequence
  Synthetic oligonucleotide
cgctggagcgcatggagaactgcaa

SEQ ID NO: 721344 - DNA, 25 bp, Artificial sequence
  Synthetic oligonucleotide
gaagcggcgctggagcgcatggaga

SEQ ID NO: 721345 - DNA, 25 bp, Artificial sequence
  Synthetic oligonucleotide
ttggcaagacactgctggtagccgc

SEQ ID NO: 721346 - DNA, 25 bp, Artificial sequence
  Synthetic oligonucleotide
agcggacgtggccatcccgccctat

SEQ ID NO: 721347 - DNA, 25 bp, Artificial sequence
  Synthetic oligonucleotide
tcgagcagtatctcggcagcaagtt

SEQ ID NO: 721348 - DNA, 25 bp, Artificial sequence
  Synthetic oligonucleotide
tcagctcctgggagcgggaattcct

SEQ ID NO: 721349 - DNA, 25 bp, Artificial sequence
  Synthetic oligonucleotide
gccggcctctggtgcgtcaacgtcg

SEQ ID NO: 721350 - DNA, 25 bp, Artificial sequence
  Synthetic oligonucleotide
cggcgtggtccgccgctcccggaca

SEQ ID NO: 721351 - DNA, 25 bp, Artificial sequence
  Synthetic oligonucleotide
gggcggccggcgtggtccgccgctc

SEQ ID NO: 721352 - DNA, 25 bp, Artificial sequence
  Synthetic oligonucleotide
ttgatcctgaccgggggcggccggc

SEQ ID NO: 721353 - DNA, 25 bp, Artificial sequence
  Synthetic oligonucleotide
tcctgctttccgtttgatcctgacc

SEQ ID NO: 721354 - DNA, 25 bp, Artificial sequence
  Synthetic oligonucleotide
aattcctcctgctttccgtttgatc

SEQ ID NO: 721355 - DNA, 25 bp, Artificial sequence
  Synthetic oligonucleotide
acgtcgcggtgaagcgtgcggagca

SEQ ID NO: 721356 - DNA, 25 bp, Artificial sequence
  Synthetic oligonucleotide
cctgggagcgggaattcctcctgct

SEQ ID NO: 721357 - DNA, 25 bp, Artificial sequence
  Synthetic oligonucleotide
gcggtgaagcgtgcggagcacgaga

SEQ ID NO: 721358 - DNA, 25 bp, Artificial sequence
  Synthetic oligonucleotide
gggtaatcagctcctgggagcggga

SEQ ID NO: 721359 - DNA, 25 bp, Artificial sequence
  Synthetic oligonucleotide
tcaagcgggtaatcagctcctggga

SEQ ID NO: 721360 - DNA, 25 bp, Artificial sequence
  Synthetic oligonucleotide
agaatttcaagcgggtaatcagctc

SEQ ID NO: 721361 - DNA, 25 bp, Artificial sequence
  Synthetic oligonucleotide
gcacgagaatttcaagcgggtaatc

SEQ ID NO: 721362 - DNA, 25 bp, Artificial sequence
  Synthetic oligonucleotide
tgcggagcacgagaatttcaagcgg

SEQ ID NO: 721363 - DNA, 25 bp, Artificial sequence
  Synthetic oligonucleotide
ccgctcccggacagtcttgaataga

SEQ ID NO: 721364 - DNA, 25 bp, Artificial sequence
  Synthetic oligonucleotide
agcgggaattcctcctgctttccgt

SEQ ID NO: 721365 - DNA, 25 bp, Artificial sequence
  Synthetic oligonucleotide
ccaagggccagccgcagaagaaagt

SEQ ID NO: 721366 - DNA, 25 bp, Artificial sequence
  Synthetic oligonucleotide
gaacggctaccacggctccaccgtc

SEQ ID NO: 721367 - DNA, 25 bp, Artificial sequence
  Synthetic oligonucleotide
ccgctggaacggctaccacggctcc

SEQ ID NO: 721368 - DNA, 25 bp, Artificial sequence
  Synthetic oligonucleotide
atcggccgctggaacggctaccacg

SEQ ID NO: 721369 - DNA, 25 bp, Artificial sequence
  Synthetic oligonucleotide
gtggtgatcggccgctggaacggct

SEQ ID NO: 721370 - DNA, 25 bp, Artificial sequence
  Synthetic oligonucleotide
aagaaagtggtgatcggccgctgga

SEQ ID NO: 721371 - DNA, 25 bp, Artificial sequence
  Synthetic oligonucleotide
caacgacaccgtgctgcgtatggtc

SEQ ID NO: 721372 - DNA, 25 bp, Artificial sequence
  Synthetic oligonucleotide
gccagccgcagaagaaagtggtgat

SEQ ID NO: 721373 - DNA, 25 bp, Artificial sequence
  Synthetic oligonucleotide
ccaccgtcgccggcgtcagcctggg

SEQ ID NO: 721374 - DNA, 25 bp, Artificial sequence
  Synthetic oligonucleotide
gggcgaccaagggccagccgcagaa

SEQ ID NO: 721375 - DNA, 25 bp, Artificial sequence
  Synthetic oligonucleotide
actattgggcgaccaagggccagcc

SEQ ID NO: 721376 - DNA, 25 bp, Artificial sequence
  Synthetic oligonucleotide
tccgccactattgggcgaccaaggg

SEQ ID NO: 721377 - DNA, 25 bp, Artificial sequence
  Synthetic oligonucleotide
tatggtccgccactattgggcgacc

SEQ ID NO: 721378 - DNA, 25 bp, Artificial sequence
  Synthetic oligonucleotide
gctgcgtatggtccgccactattgg

SEQ ID NO: 721379 - DNA, 25 bp, Artificial sequence
  Synthetic oligonucleotide
aagatcctcgatgcgatggccggcc

SEQ ID NO: 721380 - DNA, 25 bp, Artificial sequence
  Synthetic oligonucleotide
ccgcagaagaaagtggtgatcggcc

SEQ ID NO: 721381 - DNA, 25 bp, Artificial sequence
  Synthetic oligonucleotide
gttgcatgagcagggtgatttcccc

SEQ ID NO: 721382 - DNA, 25 bp, Artificial sequence
  Synthetic oligonucleotide
ctctggtgcgtcaacgtcggctacg

SEQ ID NO: 721383 - DNA, 25 bp, Artificial sequence
  Synthetic oligonucleotide
acgatcgaagcggcgctggagcgca

SEQ ID NO: 721384 - DNA, 25 bp, Artificial sequence
  Synthetic oligonucleotide
gtccacatcgcccagccctactggt

SEQ ID NO: 721385 - DNA, 25 bp, Artificial sequence
  Synthetic oligonucleotide
gggcatcgtccacatcgcccagccc

SEQ ID NO: 721386 - DNA, 25 bp, Artificial sequence
  Synthetic oligonucleotide
catcccgggcatcgtccacatcgcc

SEQ ID NO: 721387 - DNA, 25 bp, Artificial sequence
  Synthetic oligonucleotide
tttccccatcccgggcatcgtccac

SEQ ID NO: 721388 - DNA, 25 bp, Artificial sequence
  Synthetic oligonucleotide
gctaccacggctccaccgtcgccgg

SEQ ID NO: 721389 - DNA, 25 bp, Artificial sequence
  Synthetic oligonucleotide
tgagcagggtgatttccccatcccg

SEQ ID NO: 721390 - DNA, 25 bp, Artificial sequence
  Synthetic oligonucleotide
acggctccaccgtcgccggcgtcag

SEQ ID NO: 721391 - DNA, 25 bp, Artificial sequence
  Synthetic oligonucleotide
gaaggcgttgcatgagcagggtgat

SEQ ID NO: 721392 - DNA, 25 bp, Artificial sequence
  Synthetic oligonucleotide
cggcatgaaggcgttgcatgagcag

SEQ ID NO: 721393 - DNA, 25 bp, Artificial sequence
  Synthetic oligonucleotide
gcctgggcggcatgaaggcgttgca

SEQ ID NO: 721394 - DNA, 25 bp, Artificial sequence
  Synthetic oligonucleotide
gcgtcagcctgggcggcatgaaggc

SEQ ID NO: 721395 - DNA, 25 bp, Artificial sequence
  Synthetic oligonucleotide
tcgccggcgtcagcctgggcggcat

SEQ ID NO: 721396 - DNA, 25 bp, Artificial sequence
  Synthetic oligonucleotide
cgaggccaacgacaccgtgctgcgt

SEQ ID NO: 721397 - DNA, 25 bp, Artificial sequence
  Synthetic oligonucleotide
gggtgatttccccatcccgggcatc

SEQ ID NO: 721398 - DNA, 25 bp, Artificial sequence
  Synthetic oligonucleotide
agctggtccaggccgccacccggca

SEQ ID NO: 721399 - DNA, 25 bp, Artificial sequence
  Synthetic oligonucleotide
tctacaacctgttcttccagaccgc

SEQ ID NO: 721400 - DNA, 25 bp, Artificial sequence
  Synthetic oligonucleotide
tgccgttctacaacctgttcttcca

SEQ ID NO: 721401 - DNA, 25 bp, Artificial sequence
  Synthetic oligonucleotide
gcgagttgccgttctacaacctgtt

SEQ ID NO: 721402 - DNA, 25 bp, Artificial sequence
  Synthetic oligonucleotide
agatgcgcgagttgccgttctacaa

SEQ ID NO: 721403 - DNA, 25 bp, Artificial sequence
  Synthetic oligonucleotide
cccggcagatgcgcgagttgccgtt

SEQ ID NO: 721404 - DNA, 25 bp, Artificial sequence
  Synthetic oligonucleotide
accgtgctgcgtatggtccgccact

SEQ ID NO: 721405 - DNA, 25 bp, Artificial sequence
  Synthetic oligonucleotide
tccaggccgccacccggcagatgcg

SEQ ID NO: 721406 - DNA, 25 bp, Artificial sequence
  Synthetic oligonucleotide
ccgcccacccgccggtggtcgagct

SEQ ID NO: 721407 - DNA, 25 bp, Artificial sequence
  Synthetic oligonucleotide
gcgaggagctggtccaggccgccac

SEQ ID NO: 721408 - DNA, 25 bp, Artificial sequence
  Synthetic oligonucleotide
acggccgcgaggagctggtccaggc

SEQ ID NO: 721409 - DNA, 25 bp, Artificial sequence
  Synthetic oligonucleotide
tcggctacggccgcgaggagctggt

SEQ ID NO: 721410 - DNA, 25 bp, Artificial sequence
  Synthetic oligonucleotide
tcaacgtcggctacggccgcgagga

SEQ ID NO: 721411 - DNA, 25 bp, Artificial sequence
  Synthetic oligonucleotide
gtgcgtcaacgtcggctacggccgc

SEQ ID NO: 721412 - DNA, 25 bp, Artificial sequence
  Synthetic oligonucleotide
cagccctactggtacggcgagggcg

SEQ ID NO: 721413 - DNA, 25 bp, Artificial sequence
  Synthetic oligonucleotide
ccgccacccggcagatgcgcgagtt

SEQ ID NO: 721414 - DNA, 25 bp, Artificial sequence
  Synthetic oligonucleotide
tcgccgacgtcgctccggaaggcat

SEQ ID NO: 721415 - DNA, 25 bp, Artificial sequence
  Synthetic oligonucleotide
cggctccgaggccaacgacaccgtg

SEQ ID NO: 721416 - DNA, 25 bp, Artificial sequence
  Synthetic oligonucleotide
ccggctccggctccgaggccaacga

SEQ ID NO: 721417 - DNA, 25 bp, Artificial sequence
  Synthetic oligonucleotide
tcttcaccggctccggctccgaggc

SEQ ID NO: 721418 - DNA, 25 bp, Artificial sequence
  Synthetic oligonucleotide
acgtgttcttcaccggctccggctc

SEQ ID NO: 721419 - DNA, 25 bp, Artificial sequence
  Synthetic oligonucleotide
tgaaccacgtgttcttcaccggctc

SEQ ID NO: 721420 - DNA, 25 bp, Artificial sequence
  Synthetic oligonucleotide
aaggcatgaaccacgtgttcttcac

SEQ ID NO: 721421 - DNA, 25 bp, Artificial sequence
  Synthetic oligonucleotide
cctgttcttccagaccgcccacccg

SEQ ID NO: 721422 - DNA, 25 bp, Artificial sequence
  Synthetic oligonucleotide
acgtcgctccggaaggcatgaacca

SEQ ID NO: 721423 - DNA, 25 bp, Artificial sequence
  Synthetic oligonucleotide
cttccagaccgcccacccgccggtg

SEQ ID NO: 721424 - DNA, 25 bp, Artificial sequence
  Synthetic oligonucleotide
aggcgatcgccgacgtcgctccgga

SEQ ID NO: 721425 - DNA, 25 bp, Artificial sequence
  Synthetic oligonucleotide
tggccaaggcgatcgccgacgtcgc

SEQ ID NO: 721426 - DNA, 25 bp, Artificial sequence
  Synthetic oligonucleotide
tcgagctggccaaggcgatcgccga

SEQ ID NO: 721427 - DNA, 25 bp, Artificial sequence
  Synthetic oligonucleotide
cggtggtcgagctggccaaggcgat

SEQ ID NO: 721428 - DNA, 25 bp, Artificial sequence
  Synthetic oligonucleotide
acccgccggtggtcgagctggccaa

SEQ ID NO: 721429 - DNA, 25 bp, Artificial sequence
  Synthetic oligonucleotide
ctcgatgcgatggccggcctctggt

SEQ ID NO: 721430 - DNA, 25 bp, Artificial sequence
  Synthetic oligonucleotide
ctccggaaggcatgaaccacgtgtt

SEQ ID NO: 721431 - DNA, 25 bp, Artificial sequence
  Synthetic oligonucleotide
acggcaacgcggcggccaccccgct

SEQ ID NO: 721432 - DNA, 25 bp, Artificial sequence
  Synthetic oligonucleotide
gctggaccaagatcaagtccggcaa

SEQ ID NO: 721433 - DNA, 25 bp, Artificial sequence
  Synthetic oligonucleotide
aggcgatccgcaacgacccgggcat

SEQ ID NO: 721434 - DNA, 25 bp, Artificial sequence
  Synthetic oligonucleotide
gtccgaggcgatccgcaacgacccg

SEQ ID NO: 721435 - DNA, 25 bp, Artificial sequence
  Synthetic oligonucleotide
ctggtgtccgaggcgatccgcaacg

SEQ ID NO: 721436 - DNA, 25 bp, Artificial sequence
  Synthetic oligonucleotide
accccgctggtgtccgaggcgatcc

SEQ ID NO: 721437 - DNA, 25 bp, Artificial sequence
  Synthetic oligonucleotide
aacgacccgggcatctacccgagcg

SEQ ID NO: 721438 - DNA, 25 bp, Artificial sequence
  Synthetic oligonucleotide
aacgcggcggccaccccgctggtgt

SEQ ID NO: 721439 - DNA, 25 bp, Artificial sequence
  Synthetic oligonucleotide
cccgggcatctacccgagcgaagag

SEQ ID NO: 721440 - DNA, 25 bp, Artificial sequence
  Synthetic oligonucleotide
tccccaacggcaacgcggcggccac

SEQ ID NO: 721441 - DNA, 25 bp, Artificial sequence
  Synthetic oligonucleotide
ttcagttccccaacggcaacgcggc

SEQ ID NO: 721442 - DNA, 25 bp, Artificial sequence
  Synthetic oligonucleotide
gacgtggttcagttccccaacggca

SEQ ID NO: 721443 - DNA, 25 bp, Artificial sequence
  Synthetic oligonucleotide
gagatcaccgacgtggttcagttcc

SEQ ID NO: 721444 - DNA, 25 bp, Artificial sequence
  Synthetic oligonucleotide
atggccgagatcaccgacgtggttc

SEQ ID NO: 721445 - DNA, 25 bp, Artificial sequence
  Synthetic oligonucleotide
gaaatcatggccgagatcaccgacg

SEQ ID NO: 721446 - DNA, 25 bp, Artificial sequence
  Synthetic oligonucleotide
gcggccaccccgctggtgtccgagg

SEQ ID NO: 721447 - DNA, 25 bp, Artificial sequence
  Synthetic oligonucleotide
tgtataccttccccgacctgccggc

SEQ ID NO: 721448 - DNA, 25 bp, Artificial sequence
  Synthetic oligonucleotide
aacggcaacatctgcgtcgccatcg

SEQ ID NO: 721449 - DNA, 25 bp, Artificial sequence
  Synthetic oligonucleotide
cgatgacccgcagctggaccaagat

SEQ ID NO: 721450 - DNA, 25 bp, Artificial sequence
  Synthetic oligonucleotide
agcgggcgatgacccgcagctggac

SEQ ID NO: 721451 - DNA, 25 bp, Artificial sequence
  Synthetic oligonucleotide
gacccagcgggcgatgacccgcagc

SEQ ID NO: 721452 - DNA, 25 bp, Artificial sequence
  Synthetic oligonucleotide
cggccaagacccagcgggcgatgac

SEQ ID NO: 721453 - DNA, 25 bp, Artificial sequence
  Synthetic oligonucleotide
atccgcaacgacccgggcatctacc

SEQ ID NO: 721454 - DNA, 25 bp, Artificial sequence
  Synthetic oligonucleotide
tccccgacctgccggccaagaccca

SEQ ID NO: 721455 - DNA, 25 bp, Artificial sequence
  Synthetic oligonucleotide
aacttcctgatgaagccggaaatca

SEQ ID NO: 721456 - DNA, 25 bp, Artificial sequence
  Synthetic oligonucleotide
gaagctgtataccttccccgacctg

SEQ ID NO: 721457 - DNA, 25 bp, Artificial sequence
  Synthetic oligonucleotide
atgaagaagctgtataccttccccg

SEQ ID NO: 721458 - DNA, 25 bp, Artificial sequence
  Synthetic oligonucleotide
gaggtcatgaagaagctgtatacct

SEQ ID NO: 721459 - DNA, 25 bp, Artificial sequence
  Synthetic oligonucleotide
agcgaagaggtcatgaagaagctgt

SEQ ID NO: 721460 - DNA, 25 bp, Artificial sequence
  Synthetic oligonucleotide
tacccgagcgaagaggtcatgaaga

SEQ ID NO: 721461 - DNA, 25 bp, Artificial sequence
  Synthetic oligonucleotide
gcatctacccgagcgaagaggtcat

SEQ ID NO: 721462 - DNA, 25 bp, Artificial sequence
  Synthetic oligonucleotide
acctgccggccaagacccagcgggc

SEQ ID NO: 721463 - DNA, 25 bp, Artificial sequence
  Synthetic oligonucleotide
taccaggccaagtcccgcgccgaag

SEQ ID NO: 721464 - DNA, 25 bp, Artificial sequence
  Synthetic oligonucleotide
accgtcaagtacaacattcccaagg

SEQ ID NO: 721465 - DNA, 25 bp, Artificial sequence
  Synthetic oligonucleotide
aaggtcaccgtcaagtacaacattc

SEQ ID NO: 721466 - DNA, 25 bp, Artificial sequence
  Synthetic oligonucleotide
aagaacaaggtcaccgtcaagtaca

SEQ ID NO: 721467 - DNA, 25 bp, Artificial sequence
  Synthetic oligonucleotide
gaggcgaagaacaaggtcaccgtca

SEQ ID NO: 721468 - DNA, 25 bp, Artificial sequence
  Synthetic oligonucleotide
gccgaagaggcgaagaacaaggtca

SEQ ID NO: 721469 - DNA, 25 bp, Artificial sequence
  Synthetic oligonucleotide
aagccggaaatcatggccgagatca

SEQ ID NO: 721470 - DNA, 25 bp, Artificial sequence
  Synthetic oligonucleotide
ccaagtcccgcgccgaagaggcgaa

SEQ ID NO: 721471 - DNA, 25 bp, Artificial sequence
  Synthetic oligonucleotide
ccaaggaaggcgccggcagcttctt

SEQ ID NO: 721472 - DNA, 25 bp, Artificial sequence
  Synthetic oligonucleotide
gacatctaccaggccaagtcccgcg

SEQ ID NO: 721473 - DNA, 25 bp, Artificial sequence
  Synthetic oligonucleotide
tccggcgacatctaccaggccaagt

SEQ ID NO: 721474 - DNA, 25 bp, Artificial sequence
  Synthetic oligonucleotide
ggctactccggcgacatctaccagg

SEQ ID NO: 721475 - DNA, 25 bp, Artificial sequence
  Synthetic oligonucleotide
gccatcggctactccggcgacatct

SEQ ID NO: 721476 - DNA, 25 bp, Artificial sequence
  Synthetic oligonucleotide
tgcgtcgccatcggctactccggcg

SEQ ID NO: 721477 - DNA, 25 bp, Artificial sequence
  Synthetic oligonucleotide
aacatctgcgtcgccatcggctact

SEQ ID NO: 721478 - DNA, 25 bp, Artificial sequence
  Synthetic oligonucleotide
tcccgcgccgaagaggcgaagaaca

SEQ ID NO: 721479 - DNA, 25 bp, Artificial sequence
  Synthetic oligonucleotide
gccattccgaaggacgccgagaaca

SEQ ID NO: 721480 - DNA, 25 bp, Artificial sequence
  Synthetic oligonucleotide
ccaagatcaagtccggcaagtgatc

SEQ ID NO: 721481 - DNA, 25 bp, Artificial sequence
  Synthetic oligonucleotide
ttcgtcaacttcctgatgaagccgg

SEQ ID NO: 721482 - DNA, 25 bp, Artificial sequence
  Synthetic oligonucleotide
ctggccttcgtcaacttcctgatga

SEQ ID NO: 721483 - DNA, 25 bp, Artificial sequence
  Synthetic oligonucleotide
ggcgccctggccttcgtcaacttcc

SEQ ID NO: 721484 - DNA, 25 bp, Artificial sequence
  Synthetic oligonucleotide
accgagggcgccctggccttcgtca

SEQ ID NO: 721485 - DNA, 25 bp, Artificial sequence
  Synthetic oligonucleotide
gagaacaccgagggcgccctggcct

SEQ ID NO: 721486 - DNA, 25 bp, Artificial sequence
  Synthetic oligonucleotide
aagtacaacattcccaaggaaggcg

SEQ ID NO: 721487 - DNA, 25 bp, Artificial sequence
  Synthetic oligonucleotide
ccgaaggacgccgagaacaccgagg

SEQ ID NO: 721488 - DNA, 25 bp, Artificial sequence
  Synthetic oligonucleotide
aacattcccaaggaaggcgccggca

SEQ ID NO: 721489 - DNA, 25 bp, Artificial sequence
  Synthetic oligonucleotide
atggtcgccattccgaaggacgccg

SEQ ID NO: 721490 - DNA, 25 bp, Artificial sequence
  Synthetic oligonucleotide
tcgacatggtcgccattccgaagga

SEQ ID NO: 721491 - DNA, 25 bp, Artificial sequence
  Synthetic oligonucleotide
gcttcttcgacatggtcgccattcc

SEQ ID NO: 721492 - DNA, 25 bp, Artificial sequence
  Synthetic oligonucleotide
ccggcagcttcttcgacatggtcgc

SEQ ID NO: 721493 - DNA, 25 bp, Artificial sequence
  Synthetic oligonucleotide
aaggcgccggcagcttcttcgacat

SEQ ID NO: 721494 - DNA, 25 bp, Artificial sequence
  Synthetic oligonucleotide
ctgatgaagccggaaatcatggccg

SEQ ID NO: 721495 - DNA, 25 bp, Artificial sequence
  Synthetic oligonucleotide
gacgccgagaacaccgagggcgccc

SEQ ID NO: 721496 - DNA, 25 bp, Artificial sequence
  Synthetic oligonucleotide
catgtttcccggcggaatcgtcggg

SEQ ID NO: 721497 - DNA, 25 bp, Artificial sequence
  Synthetic oligonucleotide
cccgcagctggaccaagatcaagtc

SEQ ID NO: 721498 - DNA, 25 bp, Artificial sequence
  Synthetic oligonucleotide
cccgagtgatctgggcttacatcgg

SEQ ID NO: 721499 - DNA, 25 bp, Artificial sequence
  Synthetic oligonucleotide
atgaaacccgagtgatctgggctta

SEQ ID NO: 721500 - DNA, 25 bp, Artificial sequence
  Synthetic oligonucleotide
gttgtcatgaaacccgagtgatctg

SEQ ID NO: 721501 - DNA, 25 bp, Artificial sequence
  Synthetic oligonucleotide
cgtcgggttgtcatgaaacccgagt

SEQ ID NO: 721502 - DNA, 25 bp, Artificial sequence
  Synthetic oligonucleotide
ggcttacatcggcacttgaagaaca

SEQ ID NO: 721503 - DNA, 25 bp, Artificial sequence
  Synthetic oligonucleotide
tcccggcggaatcgtcgggttgtca

SEQ ID NO: 721504 - DNA, 25 bp, Artificial sequence
  Synthetic oligonucleotide
catcggcacttgaagaacacgggtc

SEQ ID NO: 721505 - DNA, 25 bp, Artificial sequence
  Synthetic oligonucleotide
tcactcatgtttcccggcggaatcg

SEQ ID NO: 721506 - DNA, 25 bp, Artificial sequence
  Synthetic oligonucleotide
cccagctcactcatgtttcccggcg

SEQ ID NO: 721507 - DNA, 25 bp, Artificial sequence
  Synthetic oligonucleotide
agggaacccagctcactcatgtttc

SEQ ID NO: 721508 - DNA, 25 bp, Artificial sequence
  Synthetic oligonucleotide
gccggtagggaacccagctcactca

SEQ ID NO: 721509 - DNA, 25 bp, Artificial sequence
  Synthetic oligonucleotide
caacacgccggtagggaacccagct

SEQ ID NO: 721510 - DNA, 25 bp, Artificial sequence
  Synthetic oligonucleotide
tgtcgctcgcaccggggccgagggc

SEQ ID NO: 721511 - DNA, 25 bp, Artificial sequence
  Synthetic oligonucleotide
cggaatcgtcgggttgtcatgaaac

SEQ ID NO: 721512 - DNA, 25 bp, Artificial sequence
  Synthetic oligonucleotide
aaggcccggaacaggagtcggacat

SEQ ID NO: 721513 - DNA, 25 bp, Artificial sequence
  Synthetic oligonucleotide
attccattggcaagacactgctggt

SEQ ID NO: 721514 - DNA, 25 bp, Artificial sequence
  Synthetic oligonucleotide
tgcaacattccattggcaagacact

SEQ ID NO: 721515 - DNA, 25 bp, Artificial sequence
  Synthetic oligonucleotide
gcgatggccggcctctggtgcgtca

SEQ ID NO: 721516 - DNA, 25 bp, Artificial sequence
  Synthetic oligonucleotide
ttgagtccctgagcggacttttgcc

SEQ ID NO: 721517 - DNA, 25 bp, Artificial sequence
  Synthetic oligonucleotide
cggacatgcaacattccattggcaa

SEQ ID NO: 721518 - DNA, 25 bp, Artificial sequence
  Synthetic oligonucleotide
tgatctgggcttacatcggcacttg

SEQ ID NO: 721519 - DNA, 25 bp, Artificial sequence
  Synthetic oligonucleotide
cggaacaggagtcggacatgcaaca

SEQ ID NO: 721520 - DNA, 25 bp, Artificial sequence
  Synthetic oligonucleotide
ccgcgccggggccggtcgtgtcgct

SEQ ID NO: 721521 - DNA, 25 bp, Artificial sequence
  Synthetic oligonucleotide
gtgctgccgtgaaaaggcccggaac

SEQ ID NO: 721522 - DNA, 25 bp, Artificial sequence
  Synthetic oligonucleotide
ggcagggtgctgccgtgaaaaggcc

SEQ ID NO: 721523 - DNA, 25 bp, Artificial sequence
  Synthetic oligonucleotide
cgaacaggcagggtgctgccgtgaa

SEQ ID NO: 721524 - DNA, 25 bp, Artificial sequence
  Synthetic oligonucleotide
cacgggtcgaacaggcagggtgctg

SEQ ID NO: 721525 - DNA, 25 bp, Artificial sequence
  Synthetic oligonucleotide
aagaacacgggtcgaacaggcaggg

SEQ ID NO: 721526 - DNA, 25 bp, Artificial sequence
  Synthetic oligonucleotide
cacttgaagaacacgggtcgaacag

SEQ ID NO: 721527 - DNA, 25 bp, Artificial sequence
  Synthetic oligonucleotide
aggagtcggacatgcaacattccat

SEQ ID NO: 721528 - DNA, 25 bp, Artificial sequence
  Synthetic oligonucleotide
gcgcctgaagccgccggcgctccgg

SEQ ID NO: 721529 - DNA, 25 bp, Artificial sequence
  Synthetic oligonucleotide
cgcgctcccctgcgaagaggttcga

SEQ ID NO: 721530 - DNA, 25 bp, Artificial sequence
  Synthetic oligonucleotide
tccggccgcgctcccctgcgaagag

SEQ ID NO: 721531 - DNA, 25 bp, Artificial sequence
  Synthetic oligonucleotide
gtttcctccggccgcgctcccctgc

SEQ ID NO: 721532 - DNA, 25 bp, Artificial sequence
  Synthetic oligonucleotide
cacgagagaaccggaacgcggccgg

SEQ ID NO: 721533 - DNA, 25 bp, Artificial sequence
  Synthetic oligonucleotide
tccggcacgagagaaccggaacgcg

SEQ ID NO: 721534 - DNA, 25 bp, Artificial sequence
  Synthetic oligonucleotide
ggtcgtgtcgctcgcaccggggccg

SEQ ID NO: 721535 - DNA, 25 bp, Artificial sequence
  Synthetic oligonucleotide
aagccgccggcgctccggcacgaga

SEQ ID NO: 721536 - DNA, 25 bp, Artificial sequence
  Synthetic oligonucleotide
ttcgactcttttgcccgttcgtcca

SEQ ID NO: 721537 - DNA, 25 bp, Artificial sequence
  Synthetic oligonucleotide
ccggcggcgcctgaagccgccggcg

SEQ ID NO: 721538 - DNA, 25 bp, Artificial sequence
  Synthetic oligonucleotide
aggagcccggcggcgcctgaagccg

SEQ ID NO: 721539 - DNA, 25 bp, Artificial sequence
  Synthetic oligonucleotide
tccgcgaggagcccggcggcgcctg

SEQ ID NO: 721540 - DNA, 25 bp, Artificial sequence
  Synthetic oligonucleotide
aagtgatccgcgaggagcccggcgg

SEQ ID NO: 721541 - DNA, 25 bp, Artificial sequence
  Synthetic oligonucleotide
tccggcaagtgatccgcgaggagcc

SEQ ID NO: 721542 - DNA, 25 bp, Artificial sequence
  Synthetic oligonucleotide
tcaagtccggcaagtgatccgcgag

SEQ ID NO: 721543 - DNA, 25 bp, Artificial sequence
  Synthetic oligonucleotide
cggcgctccggcacgagagaaccgg

SEQ ID NO: 721544 - DNA, 25 bp, Artificial sequence
  Synthetic oligonucleotide
gcccgacgaccggacgcagtatcga

SEQ ID NO: 721545 - DNA, 25 bp, Artificial sequence
  Synthetic oligonucleotide
aagacgctgccatgggcgctgcgcc

SEQ ID NO: 721546 - DNA, 25 bp, Artificial sequence
  Synthetic oligonucleotide
aatctgccgcgccggggccggtcgt

SEQ ID NO: 721547 - DNA, 25 bp, Artificial sequence
  Synthetic oligonucleotide
ctgcgccaatctgccgcgccggggc

SEQ ID NO: 721548 - DNA, 25 bp, Artificial sequence
  Synthetic oligonucleotide
ctgccatgggcgctgcgccaatctg

SEQ ID NO: 721549 - DNA, 25 bp, Artificial sequence
  Synthetic oligonucleotide
cgacgaagacgctgccatgggcgct

SEQ ID NO: 721550 - DNA, 25 bp, Artificial sequence
  Synthetic oligonucleotide
gtatcgacgacgaagacgctgccat

SEQ ID NO: 721551 - DNA, 25 bp, Artificial sequence
  Synthetic oligonucleotide
cccctgcgaagaggttcgactcttt

SEQ ID NO: 721552 - DNA, 25 bp, Artificial sequence
  Synthetic oligonucleotide
cgaccggacgcagtatcgacgacga

SEQ ID NO: 721553 - DNA, 25 bp, Artificial sequence
  Synthetic oligonucleotide
cgaagaggttcgactcttttgcccg

SEQ ID NO: 721554 - DNA, 25 bp, Artificial sequence
  Synthetic oligonucleotide
ctgggggcccgacgaccggacgcag

SEQ ID NO: 721555 - DNA, 25 bp, Artificial sequence
  Synthetic oligonucleotide
cagacgcttcctcctgggggcccga

SEQ ID NO: 721556 - DNA, 25 bp, Artificial sequence
  Synthetic oligonucleotide
tcgtccagacgcttcctcctggggg

SEQ ID NO: 721557 - DNA, 25 bp, Artificial sequence
  Synthetic oligonucleotide
gcccgttcgtccagacgcttcctcc

SEQ ID NO: 721558 - DNA, 25 bp, Artificial sequence
  Synthetic oligonucleotide
tcttttgcccgttcgtccagacgct

SEQ ID NO: 721559 - DNA, 25 bp, Artificial sequence
  Synthetic oligonucleotide
ggggccggtcgtgtcgctcgcaccg

SEQ ID NO: 721560 - DNA, 25 bp, Artificial sequence
  Synthetic oligonucleotide
gacgcagtatcgacgacgaagacgc

SEQ ID NO: 721561 - DNA, 25 bp, Artificial sequence
  Synthetic oligonucleotide
ctggagaagttcaccaaggaaaccg

SEQ ID NO: 721562 - DNA, 25 bp, Artificial sequence
  Synthetic oligonucleotide
aacgaagtgctggaagccaagttgc

SEQ ID NO: 721563 - DNA, 25 bp, Artificial sequence
  Synthetic oligonucleotide
gacagcaacgaagtgctggaagcca

SEQ ID NO: 721564 - DNA, 25 bp, Artificial sequence
  Synthetic oligonucleotide
gtctacgacagcaacgaagtgctgg

SEQ ID NO: 721565 - DNA, 25 bp, Artificial sequence
  Synthetic oligonucleotide
tacgacgtctacgacagcaacgaag

SEQ ID NO: 721566 - DNA, 25 bp, Artificial sequence
  Synthetic oligonucleotide
gtcgtctacgacgtctacgacagca

SEQ ID NO: 721567 - DNA, 25 bp, Artificial sequence
  Synthetic oligonucleotide
gtgctgcacgtgtacaactggtccg

SEQ ID NO: 721568 - DNA, 25 bp, Artificial sequence
  Synthetic oligonucleotide
accgggatcaaggtcgtctacgacg

SEQ ID NO: 721569 - DNA, 25 bp, Artificial sequence
  Synthetic oligonucleotide
agttgctggcgggcaagtccgggta

SEQ ID NO: 721570 - DNA, 25 bp, Artificial sequence
  Synthetic oligonucleotide
cggacaccctggagaagttcaccaa

SEQ ID NO: 721571 - DNA, 25 bp, Artificial sequence
  Synthetic oligonucleotide
atcgcgccggacaccctggagaagt

SEQ ID NO: 721572 - DNA, 25 bp, Artificial sequence
  Synthetic oligonucleotide
gactacatcgcgccggacaccctgg

SEQ ID NO: 721573 - DNA, 25 bp, Artificial sequence
  Synthetic oligonucleotide
tggtccgactacatcgcgccggaca

SEQ ID NO: 721574 - DNA, 25 bp, Artificial sequence
  Synthetic oligonucleotide
tacaactggtccgactacatcgcgc

SEQ ID NO: 721575 - DNA, 25 bp, Artificial sequence
  Synthetic oligonucleotide
acaagtccaagctgccgaactggaa

SEQ ID NO: 721576 - DNA, 25 bp, Artificial sequence
  Synthetic oligonucleotide
atcaaggtcgtctacgacgtctacg

SEQ ID NO: 721577 - DNA, 25 bp, Artificial sequence
  Synthetic oligonucleotide
ccgtccaactccttcctcgccaagc

SEQ ID NO: 721578 - DNA, 25 bp, Artificial sequence
  Synthetic oligonucleotide
agctcgacaagtccaagctgccgaa

SEQ ID NO: 721579 - DNA, 25 bp, Artificial sequence
  Synthetic oligonucleotide
accagaagctcgacaagtccaagct

SEQ ID NO: 721580 - DNA, 25 bp, Artificial sequence
  Synthetic oligonucleotide
gggtctaccagaagctcgacaagtc

SEQ ID NO: 721581 - DNA, 25 bp, Artificial sequence
  Synthetic oligonucleotide
aaggccggggtctaccagaagctcg

SEQ ID NO: 721582 - DNA, 25 bp, Artificial sequence
  Synthetic oligonucleotide
cagatcaaggccggggtctaccaga

SEQ ID NO: 721583 - DNA, 25 bp, Artificial sequence
  Synthetic oligonucleotide
gccaagcagatcaaggccggggtct

SEQ ID NO: 721584 - DNA, 25 bp, Artificial sequence
  Synthetic oligonucleotide
gtgctggaagccaagttgctggcgg

SEQ ID NO: 721585 - DNA, 25 bp, Artificial sequence
  Synthetic oligonucleotide
aactccttcctcgccaagcagatca

SEQ ID NO: 721586 - DNA, 25 bp, Artificial sequence
  Synthetic oligonucleotide
aagccaagttgctggcgggcaagtc

SEQ ID NO: 721587 - DNA, 25 bp, Artificial sequence
  Synthetic oligonucleotide
gtggtgccgtccaactccttcctcg

SEQ ID NO: 721588 - DNA, 25 bp, Artificial sequence
  Synthetic oligonucleotide
gacgtggtggtgccgtccaactcct

SEQ ID NO: 721589 - DNA, 25 bp, Artificial sequence
  Synthetic oligonucleotide
gggtacgacgtggtggtgccgtcca

SEQ ID NO: 721590 - DNA, 25 bp, Artificial sequence
  Synthetic oligonucleotide
caagtccgggtacgacgtggtggtg

SEQ ID NO: 721591 - DNA, 25 bp, Artificial sequence
  Synthetic oligonucleotide
ctggcgggcaagtccgggtacgacg

SEQ ID NO: 721592 - DNA, 25 bp, Artificial sequence
  Synthetic oligonucleotide
aacaaggtgctgcacgtgtacaact

SEQ ID NO: 721593 - DNA, 25 bp, Artificial sequence
  Synthetic oligonucleotide
ttcctcgccaagcagatcaaggccg

SEQ ID NO: 721594 - DNA, 25 bp, Artificial sequence
  Synthetic oligonucleotide
gcgccagtgcgttggccaggctcac

SEQ ID NO: 721595 - DNA, 25 bp, Artificial sequence
  Synthetic oligonucleotide
tcggttgcgccaccgcccggatact

SEQ ID NO: 721596 - DNA, 25 bp, Artificial sequence
  Synthetic oligonucleotide
acgcgatcggttgcgccaccgcccg

SEQ ID NO: 721597 - DNA, 25 bp, Artificial sequence
  Synthetic oligonucleotide
tggtgacgcgatcggttgcgccacc

SEQ ID NO: 721598 - DNA, 25 bp, Artificial sequence
  Synthetic oligonucleotide
ccgggtggtgacgcgatcggttgcg

SEQ ID NO: 721599 - DNA, 25 bp, Artificial sequence
  Synthetic oligonucleotide
ggctcaccgggtggtgacgcgatcg

SEQ ID NO: 721600 - DNA, 25 bp, Artificial sequence
  Synthetic oligonucleotide
cacgtgtacaactggtccgactaca

SEQ ID NO: 721601 - DNA, 25 bp, Artificial sequence
  Synthetic oligonucleotide
gtgcgttggccaggctcaccgggtg

SEQ ID NO: 721602 - DNA, 25 bp, Artificial sequence
  Synthetic oligonucleotide
gatacttcaacaaaaatggagctac

SEQ ID NO: 721603 - DNA, 25 bp, Artificial sequence
  Synthetic oligonucleotide
ctggccaacggcaacatctgcgtcg

SEQ ID NO: 721604 - DNA, 25 bp, Artificial sequence
  Synthetic oligonucleotide
tgggcgctgcgccaatctgccgcgc

SEQ ID NO: 721605 - DNA, 25 bp, Artificial sequence
  Synthetic oligonucleotide
ccctgagcggacttttgccagactg

SEQ ID NO: 721606 - DNA, 25 bp, Artificial sequence
  Synthetic oligonucleotide
gcggacttttgccagactgcgccag

SEQ ID NO: 721607 - DNA, 25 bp, Artificial sequence
  Synthetic oligonucleotide
cagactgcgccagtgcgttggccag

SEQ ID NO: 721608 - DNA, 25 bp, Artificial sequence
  Synthetic oligonucleotide
ttttgccagactgcgccagtgcgtt

SEQ ID NO: 721609 - DNA, 25 bp, Artificial sequence
  Synthetic oligonucleotide
tggccaggctcaccgggtggtgacg

SEQ ID NO: 721610 - DNA, 25 bp, Artificial sequence
  Synthetic oligonucleotide
cctgctcgccctgaccttggcgggc

SEQ ID NO: 721611 - DNA, 25 bp, Artificial sequence
  Synthetic oligonucleotide
gcggacaacaaggtgctgcacgtgt

SEQ ID NO: 721612 - DNA, 25 bp, Artificial sequence
  Synthetic oligonucleotide
caggctgcggacaacaaggtgctgc

SEQ ID NO: 721613 - DNA, 25 bp, Artificial sequence
  Synthetic oligonucleotide
tatggcgcaggctgcggacaacaag

SEQ ID NO: 721614 - DNA, 25 bp, Artificial sequence
  Synthetic oligonucleotide
ggccggtatggcgcaggctgcggac

SEQ ID NO: 721615 - DNA, 25 bp, Artificial sequence
  Synthetic oligonucleotide
ctctgtggccggtatggcgcaggct

SEQ ID NO: 721616 - DNA, 25 bp, Artificial sequence
  Synthetic oligonucleotide
ggcgggctctgtggccggtatggcg

SEQ ID NO: 721617 - DNA, 25 bp, Artificial sequence
  Synthetic oligonucleotide
cgccaccgcccggatacttcaacaa

SEQ ID NO: 721618 - DNA, 25 bp, Artificial sequence
  Synthetic oligonucleotide
gccctgaccttggcgggctctgtgg

SEQ ID NO: 721619 - DNA, 25 bp, Artificial sequence
  Synthetic oligonucleotide
cgcccggatacttcaacaaaaatgg

SEQ ID NO: 721620 - DNA, 25 bp, Artificial sequence
  Synthetic oligonucleotide
tttcggtaagaccctgctcgccctg

SEQ ID NO: 721621 - DNA, 25 bp, Artificial sequence
  Synthetic oligonucleotide
ccccgcatgatgaaacgtttcggta

SEQ ID NO: 721622 - DNA, 25 bp, Artificial sequence
  Synthetic oligonucleotide
gagctaccccgcatgatgaaacgtt

SEQ ID NO: 721623 - DNA, 25 bp, Artificial sequence
  Synthetic oligonucleotide
aaaatggagctaccccgcatgatga

SEQ ID NO: 721624 - DNA, 25 bp, Artificial sequence
  Synthetic oligonucleotide
tcaacaaaaatggagctaccccgca

SEQ ID NO: 721625 - DNA, 25 bp, Artificial sequence
  Synthetic oligonucleotide
taagaccctgctcgccctgaccttg

SEQ ID NO: 721626 - DNA, 25 bp, Artificial sequence
  Synthetic oligonucleotide
accttggcgggctctgtggccggta

SEQ ID NO: 721627 - DNA, 25 bp, Artificial sequence
  Synthetic oligonucleotide
tcgactcgccgaccgagatcctccc

SEQ ID NO: 721628 - DNA, 25 bp, Artificial sequence
  Synthetic oligonucleotide
ggagaacatccagaagctgaagcag

SEQ ID NO: 721629 - DNA, 25 bp, Artificial sequence
  Synthetic oligonucleotide
tcggctacaagccggacaccgacaa

SEQ ID NO: 721630 - DNA, 25 bp, Artificial sequence
  Synthetic oligonucleotide
ttatctcggctacaagccggacacc

SEQ ID NO: 721631 - DNA, 25 bp, Artificial sequence
  Synthetic oligonucleotide
cctgcattatctcggctacaagccg

SEQ ID NO: 721632 - DNA, 25 bp, Artificial sequence
  Synthetic oligonucleotide
ggcggccctgcattatctcggctac

SEQ ID NO: 721633 - DNA, 25 bp, Artificial sequence
  Synthetic oligonucleotide
tcctcccggcggccctgcattatct

SEQ ID NO: 721634 - DNA, 25 bp, Artificial sequence
  Synthetic oligonucleotide
cggacaccgacaatcccaaggaact

SEQ ID NO: 721635 - DNA, 25 bp, Artificial sequence
  Synthetic oligonucleotide
cgccgaccgagatcctcccggcggc

SEQ ID NO: 721636 - DNA, 25 bp, Artificial sequence
  Synthetic oligonucleotide
ccgacaatcccaaggaactcaaggc

SEQ ID NO: 721637 - DNA, 25 bp, Artificial sequence
  Synthetic oligonucleotide
gcttcctcgactcgccgaccgagat

SEQ ID NO: 721638 - DNA, 25 bp, Artificial sequence
  Synthetic oligonucleotide
cgtcagcttcctcgactcgccgacc

SEQ ID NO: 721639 - DNA, 25 bp, Artificial sequence
  Synthetic oligonucleotide
gtgcggcgtcagcttcctcgactcg

SEQ ID NO: 721640 - DNA, 25 bp, Artificial sequence
  Synthetic oligonucleotide
aagcagtgcggcgtcagcttcctcg

SEQ ID NO: 721641 - DNA, 25 bp, Artificial sequence
  Synthetic oligonucleotide
gaagctgaagcagtgcggcgtcagc

SEQ ID NO: 721642 - DNA, 25 bp, Artificial sequence
  Synthetic oligonucleotide
catccagaagctgaagcagtgcggc

SEQ ID NO: 721643 - DNA, 25 bp, Artificial sequence
  Synthetic oligonucleotide
ccgagatcctcccggcggccctgca

SEQ ID NO: 721644 - DNA, 25 bp, Artificial sequence
  Synthetic oligonucleotide
tccctacgtcacctacttccactcg

SEQ ID NO: 721645 - DNA, 25 bp, Artificial sequence
  Synthetic oligonucleotide
cactcgtcgaagtacatttccgacc

SEQ ID NO: 721646 - DNA, 25 bp, Artificial sequence
  Synthetic oligonucleotide
tcgaagtacatttccgacctggcca

SEQ ID NO: 721647 - DNA, 25 bp, Artificial sequence
  Synthetic oligonucleotide
tacttccactcgtcgaagtacattt

SEQ ID NO: 721648 - DNA, 25 bp, Artificial sequence
  Synthetic oligonucleotide
acatttccgacctggccaacggcaa

SEQ ID NO: 721649 - DNA, 25 bp, Artificial sequence
  Synthetic oligonucleotide
tccgacctggccaacggcaacatct

SEQ ID NO: 721650 - DNA, 25 bp, Artificial sequence
  Synthetic oligonucleotide
catgatgaaacgtttcggtaagacc

SEQ ID NO: 721651 - DNA, 25 bp, Artificial sequence
  Synthetic oligonucleotide
acaagccggacaccgacaatcccaa

SEQ ID NO: 721652 - DNA, 25 bp, Artificial sequence
  Synthetic oligonucleotide
cgtcacctacttccactcgtcgaag

SEQ ID NO: 721653 - DNA, 25 bp, Artificial sequence
  Synthetic oligonucleotide
atcccaaggaactcaaggcggccga

SEQ ID NO: 721654 - DNA, 25 bp, Artificial sequence
  Synthetic oligonucleotide
gatccgtccctacgtcacctacttc

SEQ ID NO: 721655 - DNA, 25 bp, Artificial sequence
  Synthetic oligonucleotide
ctgaagatccgtccctacgtcacct

SEQ ID NO: 721656 - DNA, 25 bp, Artificial sequence
  Synthetic oligonucleotide
ctgttcctgaagatccgtccctacg

SEQ ID NO: 721657 - DNA, 25 bp, Artificial sequence
  Synthetic oligonucleotide
gaagagctgttcctgaagatccgtc

SEQ ID NO: 721658 - DNA, 25 bp, Artificial sequence
  Synthetic oligonucleotide
gcggccgaagagctgttcctgaaga

SEQ ID NO: 721659 - DNA, 25 bp, Artificial sequence
  Synthetic oligonucleotide
aaggaactcaaggcggccgaagagc

SEQ ID NO: 721660 - DNA, 25 bp, Artificial sequence
  Synthetic oligonucleotide
ccaagctgccgaactggaagaacct

SEQ ID NO: 721661 - DNA, 25 bp, Artificial sequence
  Synthetic oligonucleotide
caagccggagaacatccagaagctg

SEQ ID NO: 721662 - DNA, 25 bp, Artificial sequence
  Synthetic oligonucleotide
catgtggggcaccatcggcatcggc

SEQ ID NO: 721663 - DNA, 25 bp, Artificial sequence
  Synthetic oligonucleotide
ttccctacatgtggggcaccatcgg

SEQ ID NO: 721664 - DNA, 25 bp, Artificial sequence
  Synthetic oligonucleotide
tgcgattccctacatgtggggcacc

SEQ ID NO: 721665 - DNA, 25 bp, Artificial sequence
  Synthetic oligonucleotide
gagcatgcgattccctacatgtggg

SEQ ID NO: 721666 - DNA, 25 bp, Artificial sequence
  Synthetic oligonucleotide
gacccgggcaacgagcatgcgattc

SEQ ID NO: 721667 - DNA, 25 bp, Artificial sequence
  Synthetic oligonucleotide
tggaagtcagcgacccgggcaacga

SEQ ID NO: 721668 - DNA, 25 bp, Artificial sequence
  Synthetic oligonucleotide
gggcaccatcggcatcggctacaac

SEQ ID NO: 721669 - DNA, 25 bp, Artificial sequence
  Synthetic oligonucleotide
tgatgcacaccctggaagtcagcga

SEQ ID NO: 721670 - DNA, 25 bp, Artificial sequence
  Synthetic oligonucleotide
ggcaacgagcatgcgattccctaca

SEQ ID NO: 721671 - DNA, 25 bp, Artificial sequence
  Synthetic oligonucleotide
ctcaaggcggccgaagagctgttcc

SEQ ID NO: 721672 - DNA, 25 bp, Artificial sequence
  Synthetic oligonucleotide
tgccgaactggaagaacctgaacaa

SEQ ID NO: 721673 - DNA, 25 bp, Artificial sequence
  Synthetic oligonucleotide
aggacctgatgcacaccctggaagt

SEQ ID NO: 721674 - DNA, 25 bp, Artificial sequence
  Synthetic oligonucleotide
actggaagaacctgaacaaggacct

SEQ ID NO: 721675 - DNA, 25 bp, Artificial sequence
  Synthetic oligonucleotide
tgaacaaggacctgatgcacaccct

SEQ ID NO: 721676 - DNA, 25 bp, Artificial sequence
  Synthetic oligonucleotide
agaacctgaacaaggacctgatgca

SEQ ID NO: 721677 - DNA, 25 bp, Artificial sequence
  Synthetic oligonucleotide
acaccctggaagtcagcgacccggg

SEQ ID NO: 721678 - DNA, 25 bp, Artificial sequence
  Synthetic oligonucleotide
gacctggtattcaagccggagaaca

SEQ ID NO: 721679 - DNA, 25 bp, Artificial sequence
  Synthetic oligonucleotide
gcgccggtggattcctgggacctgg

SEQ ID NO: 721680 - DNA, 25 bp, Artificial sequence
  Synthetic oligonucleotide
tcctgggacctggtattcaagccgg

SEQ ID NO: 721681 - DNA, 25 bp, Artificial sequence
  Synthetic oligonucleotide
gtcagcgacccgggcaacgagcatg

SEQ ID NO: 721682 - DNA, 25 bp, Artificial sequence
  Synthetic oligonucleotide
atcggcatcggctacaacccggaca

SEQ ID NO: 721683 - DNA, 25 bp, Artificial sequence
  Synthetic oligonucleotide
cgacaacgcgccggtggattcctgg

SEQ ID NO: 721684 - DNA, 25 bp, Artificial sequence
  Synthetic oligonucleotide
gtggattcctgggacctggtattca

SEQ ID NO: 721685 - DNA, 25 bp, Artificial sequence
  Synthetic oligonucleotide
aaggcggccttcggcgacaacgcgc

SEQ ID NO: 721686 - DNA, 25 bp, Artificial sequence
  Synthetic oligonucleotide
aaggtcaaggcggccttcggcgaca

SEQ ID NO: 721687 - DNA, 25 bp, Artificial sequence
  Synthetic oligonucleotide
ccggacaaggtcaaggcggccttcg

SEQ ID NO: 721688 - DNA, 25 bp, Artificial sequence
  Synthetic oligonucleotide
gtattcaagccggagaacatccaga

SEQ ID NO: 721689 - DNA, 25 bp, Artificial sequence
  Synthetic oligonucleotide
ctacaacccggacaaggtcaaggcg

SEQ ID NO: 721690 - DNA, 25 bp, Artificial sequence
  Synthetic oligonucleotide
atcggctacaacccggacaaggtca

SEQ ID NO: 721691 - DNA, 25 bp, Artificial sequence
  Synthetic oligonucleotide
ccttcggcgacaacgcgccggtgga

SEQ ID NO: 721692 - DNA, 25 bp, Artificial sequence
  Synthetic oligonucleotide
ggtcagctgggtgcgggagcgaatg

SEQ ID NO: 721693 - DNA, 25 bp, Artificial sequence
  Synthetic oligonucleotide
aagcagccgaccgcgatcagtttct

SEQ ID NO: 721694 - DNA, 25 bp, Artificial sequence
  Synthetic oligonucleotide
ggcggcgttgaggtcgacctggttg

SEQ ID NO: 721695 - DNA, 25 bp, Artificial sequence
  Synthetic oligonucleotide
gttgaggtcgacctggttggtgccg

SEQ ID NO: 721696 - DNA, 25 bp, Artificial sequence
  Synthetic oligonucleotide
tcgacctggttggtgccgatgcaga

SEQ ID NO: 721697 - DNA, 25 bp, Artificial sequence
  Synthetic oligonucleotide
tggttggtgccgatgcagaagcagc

SEQ ID NO: 721698 - DNA, 25 bp, Artificial sequence
  Synthetic oligonucleotide
ctgggtgcgggagcgaatgccgatg

SEQ ID NO: 721699 - DNA, 25 bp, Artificial sequence
  Synthetic oligonucleotide
gtgccgatgcagaagcagccgaccg

SEQ ID NO: 721700 - DNA, 25 bp, Artificial sequence
  Synthetic oligonucleotide
ttcgcgggcggcgttgaggtcgacc

SEQ ID NO: 721701 - DNA, 25 bp, Artificial sequence
  Synthetic oligonucleotide
tctcgaaggaattcgccgcgctctt

SEQ ID NO: 721702 - DNA, 25 bp, Artificial sequence
  Synthetic oligonucleotide
cacggatctcgaaggaattcgccgc

SEQ ID NO: 721703 - DNA, 25 bp, Artificial sequence
  Synthetic oligonucleotide
atgctagcatgttctcccttttcct

SEQ ID NO: 721704 - DNA, 25 bp, Artificial sequence
  Synthetic oligonucleotide
gccgaccgcgatcagtttcttcgcg

SEQ ID NO: 721705 - DNA, 25 bp, Artificial sequence
  Synthetic oligonucleotide
cgcgatcagtttcttcgcgcagtcg

SEQ ID NO: 721706 - DNA, 25 bp, Artificial sequence
  Synthetic oligonucleotide
cagtttcttcgcgcagtcgaagacc

SEQ ID NO: 721707 - DNA, 25 bp, Artificial sequence
  Synthetic oligonucleotide
taccgcgttcgcgggcggcgttgag

SEQ ID NO: 721708 - DNA, 25 bp, Artificial sequence
  Synthetic oligonucleotide
agcagcaggatcgcctcggccagta

SEQ ID NO: 721709 - DNA, 25 bp, Artificial sequence
  Synthetic oligonucleotide
ttcgcgcagtcgaagacctcttcgg

SEQ ID NO: 721710 - DNA, 25 bp, Artificial sequence
  Synthetic oligonucleotide
tcttcggtcagctgggtgcgggagc

SEQ ID NO: 721711 - DNA, 25 bp, Artificial sequence
  Synthetic oligonucleotide
cagtcgaagacctcttcggtcagct

SEQ ID NO: 721712 - DNA, 25 bp, Artificial sequence
  Synthetic oligonucleotide
aagacctcttcggtcagctgggtgc

SEQ ID NO: 721713 - DNA, 25 bp, Artificial sequence
  Synthetic oligonucleotide
atgcagaagcagccgaccgcgatca

SEQ ID NO: 721714 - DNA, 25 bp, Artificial sequence
  Synthetic oligonucleotide
ccgcgcagcagcaggatcgcctcgg

SEQ ID NO: 721715 - DNA, 25 bp, Artificial sequence
  Synthetic oligonucleotide
tcgccgcgctcttgatccagccgcc

SEQ ID NO: 721716 - DNA, 25 bp, Artificial sequence
  Synthetic oligonucleotide
aggaattcgccgcgctcttgatcca

SEQ ID NO: 721717 - DNA, 25 bp, Artificial sequence
  Synthetic oligonucleotide
cgctcttgatccagccgccgcgatg

SEQ ID NO: 721718 - DNA, 25 bp, Artificial sequence
  Synthetic oligonucleotide
tgatccagccgccgcgatggcagga

SEQ ID NO: 721719 - DNA, 25 bp, Artificial sequence
  Synthetic oligonucleotide
ctcatctgcgtaaacctgttgtccc

SEQ ID NO: 721720 - DNA, 25 bp, Artificial sequence
  Synthetic oligonucleotide
gcgggagcgaatgccgatgaagtgc

SEQ ID NO: 721721 - DNA, 25 bp, Artificial sequence
  Synthetic oligonucleotide
agccgccgcgatggcaggaggcgtt

SEQ ID NO: 721722 - DNA, 25 bp, Artificial sequence
  Synthetic oligonucleotide
cgcgatggcaggaggcgttcttttc

SEQ ID NO: 721723 - DNA, 25 bp, Artificial sequence
  Synthetic oligonucleotide
gcaggaggcgttcttttccgggatg

SEQ ID NO: 721724 - DNA, 25 bp, Artificial sequence
  Synthetic oligonucleotide
gcgttcttttccgggatgccgcgca

SEQ ID NO: 721725 - DNA, 25 bp, Artificial sequence
  Synthetic oligonucleotide
gcctcggccagtaccagctcagcca

SEQ ID NO: 721726 - DNA, 25 bp, Artificial sequence
  Synthetic oligonucleotide
gggatgccgcgcagcagcaggatcg

SEQ ID NO: 721727 - DNA, 25 bp, Artificial sequence
  Synthetic oligonucleotide
cggcgataccgcgttcgcgggcggc

SEQ ID NO: 721728 - DNA, 25 bp, Artificial sequence
  Synthetic oligonucleotide
aggatcgcctcggccagtaccagct

SEQ ID NO: 721729 - DNA, 25 bp, Artificial sequence
  Synthetic oligonucleotide
ggccagtaccagctcagccacagag

SEQ ID NO: 721730 - DNA, 25 bp, Artificial sequence
  Synthetic oligonucleotide
taccagctcagccacagagcgggtg

SEQ ID NO: 721731 - DNA, 25 bp, Artificial sequence
  Synthetic oligonucleotide
ctcagccacagagcgggtgttcgag

SEQ ID NO: 721732 - DNA, 25 bp, Artificial sequence
  Synthetic oligonucleotide
cacagagcgggtgttcgagtagggc

SEQ ID NO: 721733 - DNA, 25 bp, Artificial sequence
  Synthetic oligonucleotide
gcgggtgttcgagtagggcgcgttg

SEQ ID NO: 721734 - DNA, 25 bp, Artificial sequence
  Synthetic oligonucleotide
tgttcgagtagggcgcgttgaacac

SEQ ID NO: 721735 - DNA, 25 bp, Artificial sequence
  Synthetic oligonucleotide
agtagggcgcgttgaacacggcgat

SEQ ID NO: 721736 - DNA, 25 bp, Artificial sequence
  Synthetic oligonucleotide
gcgcgttgaacacggcgataccgcg

SEQ ID NO: 721737 - DNA, 25 bp, Artificial sequence
  Synthetic oligonucleotide
tgaacacggcgataccgcgttcgcg

SEQ ID NO: 721738 - DNA, 25 bp, Artificial sequence
  Synthetic oligonucleotide
ttttccgggatgccgcgcagcagca

SEQ ID NO: 721739 - DNA, 25 bp, Artificial sequence
  Synthetic oligonucleotide
cggcgctggccggcacccgcaactc

SEQ ID NO: 721740 - DNA, 25 bp, Artificial sequence
  Synthetic oligonucleotide
agagaggtcttgctcatctgcgtaa

SEQ ID NO: 721741 - DNA, 25 bp, Artificial sequence
  Synthetic oligonucleotide
gtcttgctcatctgcgtaaacctgt

SEQ ID NO: 721742 - DNA, 25 bp, Artificial sequence
  Synthetic oligonucleotide
tgcgtaaacctgttgtcccggagga

SEQ ID NO: 721743 - DNA, 25 bp, Artificial sequence
  Synthetic oligonucleotide
acctgttgtcccggaggaagtggct

SEQ ID NO: 721744 - DNA, 25 bp, Artificial sequence
  Synthetic oligonucleotide
tgtcccggaggaagtggctggaaag

SEQ ID NO: 721745 - DNA, 25 bp, Artificial sequence
  Synthetic oligonucleotide
ggaggaagtggctggaaagcgaact

SEQ ID NO: 721746 - DNA, 25 bp, Artificial sequence
  Synthetic oligonucleotide
agtggctggaaagcgaactgcgcga

SEQ ID NO: 721747 - DNA, 25 bp, Artificial sequence
  Synthetic oligonucleotide
tggaaagcgaactgcgcgaagcggg

SEQ ID NO: 721748 - DNA, 25 bp, Artificial sequence
  Synthetic oligonucleotide
gcgaactgcgcgaagcgggtccggc

SEQ ID NO: 721749 - DNA, 25 bp, Artificial sequence
  Synthetic oligonucleotide
gcgcgaagcgggtccggccggcgct

SEQ ID NO: 721750 - DNA, 25 bp, Artificial sequence
  Synthetic oligonucleotide
ttgctcttgtcgagagaggtcttgc

SEQ ID NO: 721751 - DNA, 25 bp, Artificial sequence
  Synthetic oligonucleotide
tccggccggcgctggccggcacccg

SEQ ID NO: 721752 - DNA, 25 bp, Artificial sequence
  Synthetic oligonucleotide
ttgatcttgctcttgtcgagagagg

SEQ ID NO: 721753 - DNA, 25 bp, Artificial sequence
  Synthetic oligonucleotide
ggccggcacccgcaactcggcgccc

SEQ ID NO: 721754 - DNA, 25 bp, Artificial sequence
  Synthetic oligonucleotide
gcacccgcaactcggcgcccagagg

SEQ ID NO: 721755 - DNA, 25 bp, Artificial sequence
  Synthetic oligonucleotide
caactcggcgcccagaggcactaag

SEQ ID NO: 721756 - DNA, 25 bp, Artificial sequence
  Synthetic oligonucleotide
ggcgcccagaggcactaagcgcggg

SEQ ID NO: 721757 - DNA, 25 bp, Artificial sequence
  Synthetic oligonucleotide
tcttgccacggatctcgaaggaatt

SEQ ID NO: 721758 - DNA, 25 bp, Artificial sequence
  Synthetic oligonucleotide
agcgggctggcgaattcctcgtcgt

SEQ ID NO: 721759 - DNA, 25 bp, Artificial sequence
  Synthetic oligonucleotide
cagaggcactaagcgcggggggcgt

SEQ ID NO: 721760 - DNA, 25 bp, Artificial sequence
  Synthetic oligonucleotide
cactaagcgcggggggcgtatgcta

SEQ ID NO: 721761 - DNA, 25 bp, Artificial sequence
  Synthetic oligonucleotide
gggcgtatgctagcatgttctccct

SEQ ID NO: 721762 - DNA, 25 bp, Artificial sequence
  Synthetic oligonucleotide
gcgcggggggcgtatgctagcatgt

SEQ ID NO: 721763 - DNA, 25 bp, Artificial sequence
  Synthetic oligonucleotide
agcgggtccggccggcgctggccgg

SEQ ID NO: 721764 - DNA, 25 bp, Artificial sequence
  Synthetic oligonucleotide
ttggtgtagccggcggccttcagcg

SEQ ID NO: 721765 - DNA, 25 bp, Artificial sequence
  Synthetic oligonucleotide
tgccgatgaagtgcgcatcggcgat

SEQ ID NO: 721766 - DNA, 25 bp, Artificial sequence
  Synthetic oligonucleotide
tgaagtgcgcatcggcgatcctttc

SEQ ID NO: 721767 - DNA, 25 bp, Artificial sequence
  Synthetic oligonucleotide
gcgcatcggcgatcctttccttcag

SEQ ID NO: 721768 - DNA, 25 bp, Artificial sequence
  Synthetic oligonucleotide
ggcgatcctttccttcagctcgtcg

SEQ ID NO: 721769 - DNA, 25 bp, Artificial sequence
  Synthetic oligonucleotide
cctttccttcagctcgtcgccggaa

SEQ ID NO: 721770 - DNA, 25 bp, Artificial sequence
  Synthetic oligonucleotide
cttcagctcgtcgccggaaagcgcg

SEQ ID NO: 721771 - DNA, 25 bp, Artificial sequence
  Synthetic oligonucleotide
ctcgtcgccggaaagcgcggtcttg

SEQ ID NO: 721772 - DNA, 25 bp, Artificial sequence
  Synthetic oligonucleotide
ccggaaagcgcggtcttgaggtact

SEQ ID NO: 721773 - DNA, 25 bp, Artificial sequence
  Synthetic oligonucleotide
agcgcggtcttgaggtactcgatgt

SEQ ID NO: 721774 - DNA, 25 bp, Artificial sequence
  Synthetic oligonucleotide
ggtcttgaggtactcgatgttggtg

SEQ ID NO: 721775 - DNA, 25 bp, Artificial sequence
  Synthetic oligonucleotide
ttgtcgagagaggtcttgctcatct

SEQ ID NO: 721776 - DNA, 25 bp, Artificial sequence
  Synthetic oligonucleotide
tcgatgttggtgtagccggcggcct

SEQ ID NO: 721777 - DNA, 25 bp, Artificial sequence
  Synthetic oligonucleotide
gcgaatgccgatgaagtgcgcatcg

SEQ ID NO: 721778 - DNA, 25 bp, Artificial sequence
  Synthetic oligonucleotide
tagccggcggccttcagcgtgtcca

SEQ ID NO: 721779 - DNA, 25 bp, Artificial sequence
  Synthetic oligonucleotide
cggccttcagcgtgtccacggcgtt

SEQ ID NO: 721780 - DNA, 25 bp, Artificial sequence
  Synthetic oligonucleotide
tcagcgtgtccacggcgttctggtg

SEQ ID NO: 721781 - DNA, 25 bp, Artificial sequence
  Synthetic oligonucleotide
tgtccacggcgttctggtggacacc

SEQ ID NO: 721782 - DNA, 25 bp, Artificial sequence
  Synthetic oligonucleotide
cggcgttctggtggacaccttcgag

SEQ ID NO: 721783 - DNA, 25 bp, Artificial sequence
  Synthetic oligonucleotide
tctggtggacaccttcgagaagaag

SEQ ID NO: 721784 - DNA, 25 bp, Artificial sequence
  Synthetic oligonucleotide
tggacaccttcgagaagaaggaact

SEQ ID NO: 721785 - DNA, 25 bp, Artificial sequence
  Synthetic oligonucleotide
ccttcgagaagaaggaacttgatct

SEQ ID NO: 721786 - DNA, 25 bp, Artificial sequence
  Synthetic oligonucleotide
agaagaaggaacttgatcttgctct

SEQ ID NO: 721787 - DNA, 25 bp, Artificial sequence
  Synthetic oligonucleotide
aggaacttgatcttgctcttgtcga

SEQ ID NO: 721788 - DNA, 25 bp, Artificial sequence
  Synthetic oligonucleotide
aggtactcgatgttggtgtagccgg

SEQ ID NO: 721789 - DNA, 25 bp, Artificial sequence
  Synthetic oligonucleotide
ctggcgaattcctcgtcgttggatt

SEQ ID NO: 721790 - DNA, 25 bp, Artificial sequence
  Synthetic oligonucleotide
ttggcctgtgcctcggcggtggagc

SEQ ID NO: 721791 - DNA, 25 bp, Artificial sequence
  Synthetic oligonucleotide
tgtgcctcggcggtggagccgccga

SEQ ID NO: 721792 - DNA, 25 bp, Artificial sequence
  Synthetic oligonucleotide
tcggcggtggagccgccgatgtgcg

SEQ ID NO: 721793 - DNA, 25 bp, Artificial sequence
  Synthetic oligonucleotide
gtggagccgccgatgtgcggggtca

SEQ ID NO: 721794 - DNA, 25 bp, Artificial sequence
  Synthetic oligonucleotide
ccgccgatgtgcggggtcaggatca

SEQ ID NO: 721795 - DNA, 25 bp, Artificial sequence
  Synthetic oligonucleotide
atgtgcggggtcaggatcacccggt

SEQ ID NO: 721796 - DNA, 25 bp, Artificial sequence
  Synthetic oligonucleotide
cggggtcaggatcacccggtccagg

SEQ ID NO: 721797 - DNA, 25 bp, Artificial sequence
  Synthetic oligonucleotide
caggatcacccggtccaggccacgc

SEQ ID NO: 721798 - DNA, 25 bp, Artificial sequence
  Synthetic oligonucleotide
cacccggtccaggccacgcagcggg

SEQ ID NO: 721799 - DNA, 25 bp, Artificial sequence
  Synthetic oligonucleotide
aattcctcgtcgttggatttcggct

SEQ ID NO: 721800 - DNA, 25 bp, Artificial sequence
  Synthetic oligonucleotide
ccacgcagcgggctggcgaattcct

SEQ ID NO: 721801 - DNA, 25 bp, Artificial sequence
  Synthetic oligonucleotide
gccacttccaggccgatgttggcct

SEQ ID NO: 721802 - DNA, 25 bp, Artificial sequence
  Synthetic oligonucleotide
tcgtcgttggatttcggctcgaccg

SEQ ID NO: 721803 - DNA, 25 bp, Artificial sequence
  Synthetic oligonucleotide
ttggatttcggctcgaccgggaaca

SEQ ID NO: 721804 - DNA, 25 bp, Artificial sequence
  Synthetic oligonucleotide
ttcggctcgaccgggaacacgtcga

SEQ ID NO: 721805 - DNA, 25 bp, Artificial sequence
  Synthetic oligonucleotide
tcgaccgggaacacgtcgatggcgg

SEQ ID NO: 721806 - DNA, 25 bp, Artificial sequence
  Synthetic oligonucleotide
gggaacacgtcgatggcggcgccga

SEQ ID NO: 721807 - DNA, 25 bp, Artificial sequence
  Synthetic oligonucleotide
acgtcgatggcggcgccgatcaggt

SEQ ID NO: 721808 - DNA, 25 bp, Artificial sequence
  Synthetic oligonucleotide
atggcggcgccgatcaggtgctcgt

SEQ ID NO: 721809 - DNA, 25 bp, Artificial sequence
  Synthetic oligonucleotide
gcgccgatcaggtgctcgtccttga

SEQ ID NO: 721810 - DNA, 25 bp, Artificial sequence
  Synthetic oligonucleotide
atcaggtgctcgtccttgatcgcgg

SEQ ID NO: 721811 - DNA, 25 bp, Artificial sequence
  Synthetic oligonucleotide
tgctcgtccttgatcgcggcggcca

SEQ ID NO: 721812 - DNA, 25 bp, Artificial sequence
  Synthetic oligonucleotide
gtccaggccacgcagcgggctggcg

SEQ ID NO: 721813 - DNA, 25 bp, Artificial sequence
  Synthetic oligonucleotide
gcagggccacttcggggaagttgac

SEQ ID NO: 721814 - DNA, 25 bp, Artificial sequence
  Synthetic oligonucleotide
tcatcacgccggggatgttggcgtg

SEQ ID NO: 721815 - DNA, 25 bp, Artificial sequence
  Synthetic oligonucleotide
cgccggggatgttggcgtggatgtg

SEQ ID NO: 721816 - DNA, 25 bp, Artificial sequence
  Synthetic oligonucleotide
ggatgttggcgtggatgtgcagcag

SEQ ID NO: 721817 - DNA, 25 bp, Artificial sequence
  Synthetic oligonucleotide
ttcttctccgacaaggccctggcca

SEQ ID NO: 721818 - DNA, 25 bp, Artificial sequence
  Synthetic oligonucleotide
gcatgttctcccttttccttgcccg

SEQ ID NO: 721819 - DNA, 25 bp, Artificial sequence
  Synthetic oligonucleotide
tggcgtggatgtgcagcaggcggtg

SEQ ID NO: 721820 - DNA, 25 bp, Artificial sequence
  Synthetic oligonucleotide
ggatgtgcagcaggcggtgcttgcc

SEQ ID NO: 721821 - DNA, 25 bp, Artificial sequence
  Synthetic oligonucleotide
gcagcaggcggtgcttgcctgggtg

SEQ ID NO: 721822 - DNA, 25 bp, Artificial sequence
  Synthetic oligonucleotide
aggcggtgcttgcctgggtgcgacg

SEQ ID NO: 721823 - DNA, 25 bp, Artificial sequence
  Synthetic oligonucleotide
tgcttgcctgggtgcgacggcaggg

SEQ ID NO: 721824 - DNA, 25 bp, Artificial sequence
  Synthetic oligonucleotide
ccgatgttggcctgtgcctcggcgg

SEQ ID NO: 721825 - DNA, 25 bp, Artificial sequence
  Synthetic oligonucleotide
gcgacggcagggccacttcggggaa

SEQ ID NO: 721826 - DNA, 25 bp, Artificial sequence
  Synthetic oligonucleotide
tccaggccgatgttggcctgtgcct

SEQ ID NO: 721827 - DNA, 25 bp, Artificial sequence
  Synthetic oligonucleotide
gaagttgaccgaggacaccgaggtg

SEQ ID NO: 721828 - DNA, 25 bp, Artificial sequence
  Synthetic oligonucleotide
accgaggacaccgaggtgccgttgt

SEQ ID NO: 721829 - DNA, 25 bp, Artificial sequence
  Synthetic oligonucleotide
acaccgaggtgccgttgtcgctgta

SEQ ID NO: 721830 - DNA, 25 bp, Artificial sequence
  Synthetic oligonucleotide
aggtgccgttgtcgctgtacttgac

SEQ ID NO: 721831 - DNA, 25 bp, Artificial sequence
  Synthetic oligonucleotide
cgttgtcgctgtacttgaccagctt

SEQ ID NO: 721832 - DNA, 25 bp, Artificial sequence
  Synthetic oligonucleotide
tcgctgtacttgaccagcttctccg

SEQ ID NO: 721833 - DNA, 25 bp, Artificial sequence
  Synthetic oligonucleotide
tacttgaccagcttctccgccactt

SEQ ID NO: 721834 - DNA, 25 bp, Artificial sequence
  Synthetic oligonucleotide
gaccagcttctccgccacttccagg

SEQ ID NO: 721835 - DNA, 25 bp, Artificial sequence
  Synthetic oligonucleotide
cttctccgccacttccaggccgatg

SEQ ID NO: 721836 - DNA, 25 bp, Artificial sequence
  Synthetic oligonucleotide
gcggccaggtggtccagctcgacca

SEQ ID NO: 721837 - DNA, 25 bp, Artificial sequence
  Synthetic oligonucleotide
ctgggtgcgacggcagggccacttc

SEQ ID NO: 721838 - DNA, 25 bp, Artificial sequence
  Synthetic oligonucleotide
acctgcatgcccagggcctcggcga

SEQ ID NO: 721839 - DNA, 25 bp, Artificial sequence
  Synthetic oligonucleotide
tccttgatcgcggcggccaggtggt

SEQ ID NO: 721840 - DNA, 25 bp, Artificial sequence
  Synthetic oligonucleotide
tcgtgcaggctgccgatctgcaccg

SEQ ID NO: 721841 - DNA, 25 bp, Artificial sequence
  Synthetic oligonucleotide
aggctgccgatctgcaccgcgttgc

SEQ ID NO: 721842 - DNA, 25 bp, Artificial sequence
  Synthetic oligonucleotide
ccgatctgcaccgcgttgcccagcg

SEQ ID NO: 721843 - DNA, 25 bp, Artificial sequence
  Synthetic oligonucleotide
tgcaccgcgttgcccagcggcagct

SEQ ID NO: 721844 - DNA, 25 bp, Artificial sequence
  Synthetic oligonucleotide
gcgttgcccagcggcagcttggtca

SEQ ID NO: 721845 - DNA, 25 bp, Artificial sequence
  Synthetic oligonucleotide
cccagcggcagcttggtcacggtgt

SEQ ID NO: 721846 - DNA, 25 bp, Artificial sequence
  Synthetic oligonucleotide
gcagcttggtcacggtgtcgtagaa

SEQ ID NO: 721847 - DNA, 25 bp, Artificial sequence
  Synthetic oligonucleotide
tggtcacggtgtcgtagaagaacac

SEQ ID NO: 721848 - DNA, 25 bp, Artificial sequence
  Synthetic oligonucleotide
cggtgtcgtagaagaacacctgcat

SEQ ID NO: 721849 - DNA, 25 bp, Artificial sequence
  Synthetic oligonucleotide
atgcccagcagctcgtgcaggctgc

SEQ ID NO: 721850 - DNA, 25 bp, Artificial sequence
  Synthetic oligonucleotide
aagaacacctgcatgcccagggcct

SEQ ID NO: 721851 - DNA, 25 bp, Artificial sequence
  Synthetic oligonucleotide
tcggacatgcccagcagctcgtgca

SEQ ID NO: 721852 - DNA, 25 bp, Artificial sequence
  Synthetic oligonucleotide
atgcccagggcctcggcgagtaccg

SEQ ID NO: 721853 - DNA, 25 bp, Artificial sequence
  Synthetic oligonucleotide
agggcctcggcgagtaccgagagct

SEQ ID NO: 721854 - DNA, 25 bp, Artificial sequence
  Synthetic oligonucleotide
tcggcgagtaccgagagctgggtgc

SEQ ID NO: 721855 - DNA, 25 bp, Artificial sequence
  Synthetic oligonucleotide
agtaccgagagctgggtgccgatcg

SEQ ID NO: 721856 - DNA, 25 bp, Artificial sequence
  Synthetic oligonucleotide
gagagctgggtgccgatcgagccgt

SEQ ID NO: 721857 - DNA, 25 bp, Artificial sequence
  Synthetic oligonucleotide
tgggtgccgatcgagccgtagccga

SEQ ID NO: 721858 - DNA, 25 bp, Artificial sequence
  Synthetic oligonucleotide
ccgatcgagccgtagccgacgatgc

SEQ ID NO: 721859 - DNA, 25 bp, Artificial sequence
  Synthetic oligonucleotide
gagccgtagccgacgatgccgagct

SEQ ID NO: 721860 - DNA, 25 bp, Artificial sequence
  Synthetic oligonucleotide
tagccgacgatgccgagcttcttgc

SEQ ID NO: 721861 - DNA, 25 bp, Artificial sequence
  Synthetic oligonucleotide
acgatgccgagcttcttgccacgga

SEQ ID NO: 721862 - DNA, 25 bp, Artificial sequence
  Synthetic oligonucleotide
cgtagaagaacacctgcatgcccag

SEQ ID NO: 721863 - DNA, 25 bp, Artificial sequence
  Synthetic oligonucleotide
gcggatttccttctcgccgatcatc

SEQ ID NO: 721864 - DNA, 25 bp, Artificial sequence
  Synthetic oligonucleotide
cgagcttcttgccacggatctcgaa

SEQ ID NO: 721865 - DNA, 25 bp, Artificial sequence
  Synthetic oligonucleotide
aggtggtccagctcgaccactgtgc

SEQ ID NO: 721866 - DNA, 25 bp, Artificial sequence
  Synthetic oligonucleotide
tccagctcgaccactgtgccgcgcg

SEQ ID NO: 721867 - DNA, 25 bp, Artificial sequence
  Synthetic oligonucleotide
ctcgaccactgtgccgcgcgcggcg

SEQ ID NO: 721868 - DNA, 25 bp, Artificial sequence
  Synthetic oligonucleotide
actgtgccgcgcgcggcgttgatca

SEQ ID NO: 721869 - DNA, 25 bp, Artificial sequence
  Synthetic oligonucleotide
ccgcgcgcggcgttgatcaggatgc

SEQ ID NO: 721870 - DNA, 25 bp, Artificial sequence
  Synthetic oligonucleotide
gcggcgttgatcaggatgccgccct

SEQ ID NO: 721871 - DNA, 25 bp, Artificial sequence
  Synthetic oligonucleotide
ttgatcaggatgccgcccttcttca

SEQ ID NO: 721872 - DNA, 25 bp, Artificial sequence
  Synthetic oligonucleotide
aggatgccgcccttcttcatcgcgc

SEQ ID NO: 721873 - DNA, 25 bp, Artificial sequence
  Synthetic oligonucleotide
ccgcccttcttcatcgcgcggattt

SEQ ID NO: 721874 - DNA, 25 bp, Artificial sequence
  Synthetic oligonucleotide
agcagctcgtgcaggctgccgatct

SEQ ID NO: 721875 - DNA, 25 bp, Artificial sequence
  Synthetic oligonucleotide
atcgcgcggatttccttctcgccga

SEQ ID NO: 721876 - DNA, 25 bp, Artificial sequence
  Synthetic oligonucleotide
atcgcggcggccaggtggtccagct

SEQ ID NO: 721877 - DNA, 25 bp, Artificial sequence
  Synthetic oligonucleotide
ttccttctcgccgatcatccactgg

SEQ ID NO: 721878 - DNA, 25 bp, Artificial sequence
  Synthetic oligonucleotide
ctcgccgatcatccactgggtggag

SEQ ID NO: 721879 - DNA, 25 bp, Artificial sequence
  Synthetic oligonucleotide
atcatccactgggtggagggcagtt

SEQ ID NO: 721880 - DNA, 25 bp, Artificial sequence
  Synthetic oligonucleotide
cactgggtggagggcagttcgggaa

SEQ ID NO: 721881 - DNA, 25 bp, Artificial sequence
  Synthetic oligonucleotide
gtggagggcagttcgggaacgtgca

SEQ ID NO: 721882 - DNA, 25 bp, Artificial sequence
  Synthetic oligonucleotide
ggcagttcgggaacgtgcagcgaga

SEQ ID NO: 721883 - DNA, 25 bp, Artificial sequence
  Synthetic oligonucleotide
tcgggaacgtgcagcgagacgatgt

SEQ ID NO: 721884 - DNA, 25 bp, Artificial sequence
  Synthetic oligonucleotide
acgtgcagcgagacgatgtcggaca

SEQ ID NO: 721885 - DNA, 25 bp, Artificial sequence
  Synthetic oligonucleotide
agcgagacgatgtcggacatgccca

SEQ ID NO: 721886 - DNA, 25 bp, Artificial sequence
  Synthetic oligonucleotide
acgatgtcggacatgcccagcagct

SEQ ID NO: 721887 - DNA, 25 bp, Artificial sequence
  Synthetic oligonucleotide
ttcttcatcgcgcggatttccttct

SEQ ID NO: 721888 - DNA, 25 bp, Artificial sequence
  Synthetic oligonucleotide
ggcgttcgagaccgactgcccgttc

SEQ ID NO: 721889 - DNA, 25 bp, Artificial sequence
  Synthetic oligonucleotide
aagctcgacctgaccgccttcgagt

SEQ ID NO: 721890 - DNA, 25 bp, Artificial sequence
  Synthetic oligonucleotide
gacctgaccgccttcgagttcttct

SEQ ID NO: 721891 - DNA, 25 bp, Artificial sequence
  Synthetic oligonucleotide
ttcgagttcttctccgacaaggccc

SEQ ID NO: 721892 - DNA, 25 bp, Artificial sequence
  Synthetic oligonucleotide
tccgacaaggccctggccaaggtcc

SEQ ID NO: 721893 - DNA, 25 bp, Artificial sequence
  Synthetic oligonucleotide
caaggccctggccaaggtcctggcc

SEQ ID NO: 721894 - DNA, 25 bp, Artificial sequence
  Synthetic oligonucleotide
cctggccaaggtcctggcccgtggc

SEQ ID NO: 721895 - DNA, 25 bp, Artificial sequence
  Synthetic oligonucleotide
caaggtcctggcccgtggcgatgta

SEQ ID NO: 721896 - DNA, 25 bp, Artificial sequence
  Synthetic oligonucleotide
ctggcccgtggcgatgtaccacggg

SEQ ID NO: 721897 - DNA, 25 bp, Artificial sequence
  Synthetic oligonucleotide
cgtggcgatgtaccacgggcgttcg

SEQ ID NO: 721898 - DNA, 25 bp, Artificial sequence
  Synthetic oligonucleotide
ccaacgaggcgctggccaccttcga

SEQ ID NO: 721899 - DNA, 25 bp, Artificial sequence
  Synthetic oligonucleotide
accacgggcgttcgagaccgactgc

SEQ ID NO: 721900 - DNA, 25 bp, Artificial sequence
  Synthetic oligonucleotide
tgctgcatgccttccagagcaagct

SEQ ID NO: 721901 - DNA, 25 bp, Artificial sequence
  Synthetic oligonucleotide
tcgagaccgactgcccgttctacgc

SEQ ID NO: 721902 - DNA, 25 bp, Artificial sequence
  Synthetic oligonucleotide
ccgactgcccgttctacgccctgct

SEQ ID NO: 721903 - DNA, 25 bp, Artificial sequence
  Synthetic oligonucleotide
gcccgttctacgccctgctggagtt

SEQ ID NO: 721904 - DNA, 25 bp, Artificial sequence
  Synthetic oligonucleotide
tctacgccctgctggagttcgaggc

SEQ ID NO: 721905 - DNA, 25 bp, Artificial sequence
  Synthetic oligonucleotide
ccctgctggagttcgaggcgaccac

SEQ ID NO: 721906 - DNA, 25 bp, Artificial sequence
  Synthetic oligonucleotide
ggagttcgaggcgaccaccgaggaa

SEQ ID NO: 721907 - DNA, 25 bp, Artificial sequence
  Synthetic oligonucleotide
tcgaggcgaccaccgaggaagtcgc

SEQ ID NO: 721908 - DNA, 25 bp, Artificial sequence
  Synthetic oligonucleotide
cgaccaccgaggaagtcgccaacga

SEQ ID NO: 721909 - DNA, 25 bp, Artificial sequence
  Synthetic oligonucleotide
cgaggaagtcgccaacgaggcgctg

SEQ ID NO: 721910 - DNA, 25 bp, Artificial sequence
  Synthetic oligonucleotide
accgccttcgagttcttctccgaca

SEQ ID NO: 721911 - DNA, 25 bp, Artificial sequence
  Synthetic oligonucleotide
gatgtaccacgggcgttcgagaccg

SEQ ID NO: 721912 - DNA, 25 bp, Artificial sequence
  Synthetic oligonucleotide
cgccgaagaacctcaccgctatggt

SEQ ID NO: 721913 - DNA, 25 bp, Artificial sequence
  Synthetic oligonucleotide
gccagctgttcatcggcgccgaagg

SEQ ID NO: 721914 - DNA, 25 bp, Artificial sequence
  Synthetic oligonucleotide
tgttcatcggcgccgaaggcaccct

SEQ ID NO: 721915 - DNA, 25 bp, Artificial sequence
  Synthetic oligonucleotide
tcggcgccgaaggcaccctgggctt

SEQ ID NO: 721916 - DNA, 25 bp, Artificial sequence
  Synthetic oligonucleotide
ccgaaggcaccctgggcttcgtggt

SEQ ID NO: 721917 - DNA, 25 bp, Artificial sequence
  Synthetic oligonucleotide
gcaccctgggcttcgtggtcgaggc

SEQ ID NO: 721918 - DNA, 25 bp, Artificial sequence
  Synthetic oligonucleotide
tgggcttcgtggtcgaggcgaccat

SEQ ID NO: 721919 - DNA, 25 bp, Artificial sequence
  Synthetic oligonucleotide
ttcgtggtcgaggcgaccatgcgtc

SEQ ID NO: 721920 - DNA, 25 bp, Artificial sequence
  Synthetic oligonucleotide
gtcgaggcgaccatgcgtctggagc

SEQ ID NO: 721921 - DNA, 25 bp, Artificial sequence
  Synthetic oligonucleotide
gcgaccatgcgtctggagcgcacgc

SEQ ID NO: 721922 - DNA, 25 bp, Artificial sequence
  Synthetic oligonucleotide
catgcgtctggagcgcacgccgaag

SEQ ID NO: 721923 - DNA, 25 bp, Artificial sequence
  Synthetic oligonucleotide
ccagagcaagctcgacctgaccgcc

SEQ ID NO: 721924 - DNA, 25 bp, Artificial sequence
  Synthetic oligonucleotide
agcgcacgccgaagaacctcaccgc

SEQ ID NO: 721925 - DNA, 25 bp, Artificial sequence
  Synthetic oligonucleotide
tgccttccagagcaagctcgacctg

SEQ ID NO: 721926 - DNA, 25 bp, Artificial sequence
  Synthetic oligonucleotide
agaacctcaccgctatggtcctcgg

SEQ ID NO: 721927 - DNA, 25 bp, Artificial sequence
  Synthetic oligonucleotide
tcaccgctatggtcctcggcacgcc

SEQ ID NO: 721928 - DNA, 25 bp, Artificial sequence
  Synthetic oligonucleotide
ctatggtcctcggcacgcccgactt

SEQ ID NO: 721929 - DNA, 25 bp, Artificial sequence
  Synthetic oligonucleotide
tcctcggcacgcccgacttcgactc

SEQ ID NO: 721930 - DNA, 25 bp, Artificial sequence
  Synthetic oligonucleotide
gcacgcccgacttcgactcgatcat

SEQ ID NO: 721931 - DNA, 25 bp, Artificial sequence
  Synthetic oligonucleotide
ccgacttcgactcgatcatgccggt

SEQ ID NO: 721932 - DNA, 25 bp, Artificial sequence
  Synthetic oligonucleotide
tcgactcgatcatgccggtgctgca

SEQ ID NO: 721933 - DNA, 25 bp, Artificial sequence
  Synthetic oligonucleotide
cgatcatgccggtgctgcatgcctt

SEQ ID NO: 721934 - DNA, 25 bp, Artificial sequence
  Synthetic oligonucleotide
tgccggtgctgcatgccttccagag

SEQ ID NO: 721935 - DNA, 25 bp, Artificial sequence
  Synthetic oligonucleotide
aggcgctggccaccttcgagcactg

SEQ ID NO: 721936 - DNA, 25 bp, Artificial sequence
  Synthetic oligonucleotide
gtctggagcgcacgccgaagaacct

SEQ ID NO: 721937 - DNA, 25 bp, Artificial sequence
  Synthetic oligonucleotide
ggccacatcggcgacggcaacctgc

SEQ ID NO: 721938 - DNA, 25 bp, Artificial sequence
  Synthetic oligonucleotide
cccgccttcctcaaggacatcgacg

SEQ ID NO: 721939 - DNA, 25 bp, Artificial sequence
  Synthetic oligonucleotide
ttcctcaaggacatcgacgccatcg

SEQ ID NO: 721940 - DNA, 25 bp, Artificial sequence
  Synthetic oligonucleotide
aaggacatcgacgccatcgtcgagg

SEQ ID NO: 721941 - DNA, 25 bp, Artificial sequence
  Synthetic oligonucleotide
tcgacgccatcgtcgaggccaacta

SEQ ID NO: 721942 - DNA, 25 bp, Artificial sequence
  Synthetic oligonucleotide
catcgtcgaggccaactacccggac

SEQ ID NO: 721943 - DNA, 25 bp, Artificial sequence
  Synthetic oligonucleotide
cgaggccaactacccggacttcgag

SEQ ID NO: 721944 - DNA, 25 bp, Artificial sequence
  Synthetic oligonucleotide
caactacccggacttcgaggtggtg

SEQ ID NO: 721945 - DNA, 25 bp, Artificial sequence
  Synthetic oligonucleotide
ccggacttcgaggtggtgtggttcg

SEQ ID NO: 721946 - DNA, 25 bp, Artificial sequence
  Synthetic oligonucleotide
ttcgaggtggtgtggttcggccaca

SEQ ID NO: 721947 - DNA, 25 bp, Artificial sequence
  Synthetic oligonucleotide
aagtcgccaacgaggcgctggccac

SEQ ID NO: 721948 - DNA, 25 bp, Artificial sequence
  Synthetic oligonucleotide
gtggttcggccacatcggcgacggc

SEQ ID NO: 721949 - DNA, 25 bp, Artificial sequence
  Synthetic oligonucleotide
acaagaacgacatctcggtcacggt

SEQ ID NO: 721950 - DNA, 25 bp, Artificial sequence
  Synthetic oligonucleotide
atcggcgacggcaacctgcacctga

SEQ ID NO: 721951 - DNA, 25 bp, Artificial sequence
  Synthetic oligonucleotide
gacggcaacctgcacctgaacatcc

SEQ ID NO: 721952 - DNA, 25 bp, Artificial sequence
  Synthetic oligonucleotide
aacctgcacctgaacatcctcaagc

SEQ ID NO: 721953 - DNA, 25 bp, Artificial sequence
  Synthetic oligonucleotide
gcacctgaacatcctcaagccggaa

SEQ ID NO: 721954 - DNA, 25 bp, Artificial sequence
  Synthetic oligonucleotide
tgaacatcctcaagccggaaaacct

SEQ ID NO: 721955 - DNA, 25 bp, Artificial sequence
  Synthetic oligonucleotide
tcctcaagccggaaaacctcggcaa

SEQ ID NO: 721956 - DNA, 25 bp, Artificial sequence
  Synthetic oligonucleotide
aacctcggcaaggacgagttcttcg

SEQ ID NO: 721957 - DNA, 25 bp, Artificial sequence
  Synthetic oligonucleotide
tctcgctcatcacgccggggatgtt

SEQ ID NO: 721958 - DNA, 25 bp, Artificial sequence
  Synthetic oligonucleotide
gaagcggccgtcggccttgatcttc

SEQ ID NO: 721959 - DNA, 25 bp, Artificial sequence
  Synthetic oligonucleotide
ggcaaggacgagttcttcgccaagt

SEQ ID NO: 721960 - DNA, 25 bp, Artificial sequence
  Synthetic oligonucleotide
ggtggtgtggttcggccacatcggc

SEQ ID NO: 721961 - DNA, 25 bp, Artificial sequence
  Synthetic oligonucleotide
tgcagaacctgtggaagctgcgcga

SEQ ID NO: 721962 - DNA, 25 bp, Artificial sequence
  Synthetic oligonucleotide
tggccaccttcgagcactgcgtcga

SEQ ID NO: 721963 - DNA, 25 bp, Artificial sequence
  Synthetic oligonucleotide
ccttcgagcactgcgtcgagcaggg

SEQ ID NO: 721964 - DNA, 25 bp, Artificial sequence
  Synthetic oligonucleotide
agcactgcgtcgagcagggctgggt

SEQ ID NO: 721965 - DNA, 25 bp, Artificial sequence
  Synthetic oligonucleotide
gcgtcgagcagggctgggtgctgga

SEQ ID NO: 721966 - DNA, 25 bp, Artificial sequence
  Synthetic oligonucleotide
agcagggctgggtgctggacggggt

SEQ ID NO: 721967 - DNA, 25 bp, Artificial sequence
  Synthetic oligonucleotide
gctgggtgctggacggggtgatgag

SEQ ID NO: 721968 - DNA, 25 bp, Artificial sequence
  Synthetic oligonucleotide
tgctggacggggtgatgagccagag

SEQ ID NO: 721969 - DNA, 25 bp, Artificial sequence
  Synthetic oligonucleotide
acggggtgatgagccagagcgagca

SEQ ID NO: 721970 - DNA, 25 bp, Artificial sequence
  Synthetic oligonucleotide
tgatgagccagagcgagcagcagtt

SEQ ID NO: 721971 - DNA, 25 bp, Artificial sequence
  Synthetic oligonucleotide
gccagagcgagcagcagttgcagaa

SEQ ID NO: 721972 - DNA, 25 bp, Artificial sequence
  Synthetic oligonucleotide
cgggtgcccgccttcctcaaggaca

SEQ ID NO: 721973 - DNA, 25 bp, Artificial sequence
  Synthetic oligonucleotide
agcagttgcagaacctgtggaagct

SEQ ID NO: 721974 - DNA, 25 bp, Artificial sequence
  Synthetic oligonucleotide
acgacatctcggtcacggtttcccg

SEQ ID NO: 721975 - DNA, 25 bp, Artificial sequence
  Synthetic oligonucleotide
acctgtggaagctgcgcgagtacat

SEQ ID NO: 721976 - DNA, 25 bp, Artificial sequence
  Synthetic oligonucleotide
ggaagctgcgcgagtacatctccga

SEQ ID NO: 721977 - DNA, 25 bp, Artificial sequence
  Synthetic oligonucleotide
tgcgcgagtacatctccgagaccat

SEQ ID NO: 721978 - DNA, 25 bp, Artificial sequence
  Synthetic oligonucleotide
agtacatctccgagaccatctccca

SEQ ID NO: 721979 - DNA, 25 bp, Artificial sequence
  Synthetic oligonucleotide
tctccgagaccatctcccactggac

SEQ ID NO: 721980 - DNA, 25 bp, Artificial sequence
  Synthetic oligonucleotide
agaccatctcccactggacgccgta

SEQ ID NO: 721981 - DNA, 25 bp, Artificial sequence
  Synthetic oligonucleotide
tctcccactggacgccgtacaagaa

SEQ ID NO: 721982 - DNA, 25 bp, Artificial sequence
  Synthetic oligonucleotide
actggacgccgtacaagaacgacat

SEQ ID NO: 721983 - DNA, 25 bp, Artificial sequence
  Synthetic oligonucleotide
cgccgtacaagaacgacatctcggt

SEQ ID NO: 721984 - DNA, 25 bp, Artificial sequence
  Synthetic oligonucleotide
ccaccggctacgacatgcgccagct

SEQ ID NO: 721985 - DNA, 25 bp, Artificial sequence
  Synthetic oligonucleotide
gcgagcagcagttgcagaacctgtg

SEQ ID NO: 721986 - DNA, 25 bp, Artificial sequence
  Synthetic oligonucleotide
gtccaggcgatcgtccgctgggcca

SEQ ID NO: 721987 - DNA, 25 bp, Artificial sequence
  Synthetic oligonucleotide
aggactggaccaagcatttcgcccc

SEQ ID NO: 721988 - DNA, 25 bp, Artificial sequence
  Synthetic oligonucleotide
ggaccaagcatttcgcccctgcgcc

SEQ ID NO: 721989 - DNA, 25 bp, Artificial sequence
  Synthetic oligonucleotide
agcatttcgcccctgcgccgctggc

SEQ ID NO: 721990 - DNA, 25 bp, Artificial sequence
  Synthetic oligonucleotide
tcgcccctgcgccgctggccatcgt

SEQ ID NO: 721991 - DNA, 25 bp, Artificial sequence
  Synthetic oligonucleotide
ctgcgccgctggccatcgtgttccc

SEQ ID NO: 721992 - DNA, 25 bp, Artificial sequence
  Synthetic oligonucleotide
cgctggccatcgtgttccccaagag

SEQ ID NO: 721993 - DNA, 25 bp, Artificial sequence
  Synthetic oligonucleotide
catcgtgttccccaagagcgtcgag

SEQ ID NO: 721994 - DNA, 25 bp, Artificial sequence
  Synthetic oligonucleotide
tgttccccaagagcgtcgagcaggt

SEQ ID NO: 721995 - DNA, 25 bp, Artificial sequence
  Synthetic oligonucleotide
cccaagagcgtcgagcaggtccagg

SEQ ID NO: 721996 - DNA, 25 bp, Artificial sequence
  Synthetic oligonucleotide
acatgcgccagctgttcatcggcgc

SEQ ID NO: 721997 - DNA, 25 bp, Artificial sequence
  Synthetic oligonucleotide
gagcaggtccaggcgatcgtccgct

SEQ ID NO: 721998 - DNA, 25 bp, Artificial sequence
  Synthetic oligonucleotide
ccctggacgcctacggcaaggactg

SEQ ID NO: 721999 - DNA, 25 bp, Artificial sequence
  Synthetic oligonucleotide
gcgatcgtccgctgggccaaccagc

SEQ ID NO: 722000 - DNA, 25 bp, Artificial sequence
  Synthetic oligonucleotide
gtccgctgggccaaccagcacaagg

SEQ ID NO: 722001 - DNA, 25 bp, Artificial sequence
  Synthetic oligonucleotide
tgggccaaccagcacaaggtcggtc

SEQ ID NO: 722002 - DNA, 25 bp, Artificial sequence
  Synthetic oligonucleotide
aaccagcacaaggtcggtctggtcc

SEQ ID NO: 722003 - DNA, 25 bp, Artificial sequence
  Synthetic oligonucleotide
gcacaaggtcggtctggtcccgtcg

SEQ ID NO: 722004 - DNA, 25 bp, Artificial sequence
  Synthetic oligonucleotide
gcggtcgtaccgggctctccgccgc

SEQ ID NO: 722005 - DNA, 25 bp, Artificial sequence
  Synthetic oligonucleotide
cgtaccgggctctccgccgcggccg

SEQ ID NO: 722006 - DNA, 25 bp, Artificial sequence
  Synthetic oligonucleotide
gggctctccgccgcggccgtggcgg

SEQ ID NO: 722007 - DNA, 25 bp, Artificial sequence
  Synthetic oligonucleotide
tccgccgcggccgtggcggccaacg

SEQ ID NO: 722008 - DNA, 25 bp, Artificial sequence
  Synthetic oligonucleotide
gcggccgtggcggccaacggcgaag

SEQ ID NO: 722009 - DNA, 25 bp, Artificial sequence
  Synthetic oligonucleotide
agcgtcgagcaggtccaggcgatcg

SEQ ID NO: 722010 - DNA, 25 bp, Artificial sequence
  Synthetic oligonucleotide
gccctgatcgaatcgctcaagcccc

SEQ ID NO: 722011 - DNA, 25 bp, Artificial sequence
  Synthetic oligonucleotide
cttgcccggttgcgacctgagttgt

SEQ ID NO: 722012 - DNA, 25 bp, Artificial sequence
  Synthetic oligonucleotide
cggttgcgacctgagttgttctcag

SEQ ID NO: 722013 - DNA, 25 bp, Artificial sequence
  Synthetic oligonucleotide
cgacctgagttgttctcaggacgac

SEQ ID NO: 722014 - DNA, 25 bp, Artificial sequence
  Synthetic oligonucleotide
gagttgttctcaggacgaccatgaa

SEQ ID NO: 722015 - DNA, 25 bp, Artificial sequence
  Synthetic oligonucleotide
ttctcaggacgaccatgaatcattt

SEQ ID NO: 722016 - DNA, 25 bp, Artificial sequence
  Synthetic oligonucleotide
ggacgaccatgaatcatttgagagt

SEQ ID NO: 722017 - DNA, 25 bp, Artificial sequence
  Synthetic oligonucleotide
ccatgaatcatttgagagttcccga

SEQ ID NO: 722018 - DNA, 25 bp, Artificial sequence
  Synthetic oligonucleotide
atcatttgagagttcccgaatgacc

SEQ ID NO: 722019 - DNA, 25 bp, Artificial sequence
  Synthetic oligonucleotide
tgagagttcccgaatgacccgcgaa

SEQ ID NO: 722020 - DNA, 25 bp, Artificial sequence
  Synthetic oligonucleotide
ttcccgaatgacccgcgaagccctg

SEQ ID NO: 722021 - DNA, 25 bp, Artificial sequence
  Synthetic oligonucleotide
acggcaaggactggaccaagcattt

SEQ ID NO: 722022 - DNA, 25 bp, Artificial sequence
  Synthetic oligonucleotide
cgcgaagccctgatcgaatcgctca

SEQ ID NO: 722023 - DNA, 25 bp, Artificial sequence
  Synthetic oligonucleotide
acgcctacggcaaggactggaccaa

SEQ ID NO: 722024 - DNA, 25 bp, Artificial sequence
  Synthetic oligonucleotide
atcgaatcgctcaagcccctggtcg

SEQ ID NO: 722025 - DNA, 25 bp, Artificial sequence
  Synthetic oligonucleotide
tcgctcaagcccctggtcgagcctg

SEQ ID NO: 722026 - DNA, 25 bp, Artificial sequence
  Synthetic oligonucleotide
agcccctggtcgagcctggcaagct

SEQ ID NO: 722027 - DNA, 25 bp, Artificial sequence
  Synthetic oligonucleotide
tggtcgagcctggcaagctgctcga

SEQ ID NO: 722028 - DNA, 25 bp, Artificial sequence
  Synthetic oligonucleotide
agcctggcaagctgctcgacgacgc

SEQ ID NO: 722029 - DNA, 25 bp, Artificial sequence
  Synthetic oligonucleotide
gcaagctgctcgacgacgccgcctc

SEQ ID NO: 722030 - DNA, 25 bp, Artificial sequence
  Synthetic oligonucleotide
tgctcgacgacgccgcctccctgga

SEQ ID NO: 722031 - DNA, 25 bp, Artificial sequence
  Synthetic oligonucleotide
acgacgccgcctccctggacgccta

SEQ ID NO: 722032 - DNA, 25 bp, Artificial sequence
  Synthetic oligonucleotide
ccgcctccctggacgcctacggcaa

SEQ ID NO: 722033 - DNA, 25 bp, Artificial sequence
  Synthetic oligonucleotide
gcgaagtcgtggtggccttcgacta

SEQ ID NO: 722034 - DNA, 25 bp, Artificial sequence
  Synthetic oligonucleotide
aatgacccgcgaagccctgatcgaa

SEQ ID NO: 722035 - DNA, 25 bp, Artificial sequence
  Synthetic oligonucleotide
gatgaaggtcgtcaccggcaagggc

SEQ ID NO: 722036 - DNA, 25 bp, Artificial sequence
  Synthetic oligonucleotide
gtggcggccaacggcgaagtcgtgg

SEQ ID NO: 722037 - DNA, 25 bp, Artificial sequence
  Synthetic oligonucleotide
atcggcaccaatgccggcgggatca

SEQ ID NO: 722038 - DNA, 25 bp, Artificial sequence
  Synthetic oligonucleotide
accaatgccggcgggatcaaggtca

SEQ ID NO: 722039 - DNA, 25 bp, Artificial sequence
  Synthetic oligonucleotide
gccggcgggatcaaggtcattcgct

SEQ ID NO: 722040 - DNA, 25 bp, Artificial sequence
  Synthetic oligonucleotide
gggatcaaggtcattcgctacggca

SEQ ID NO: 722041 - DNA, 25 bp, Artificial sequence
  Synthetic oligonucleotide
caaggtcattcgctacggcatgacc

SEQ ID NO: 722042 - DNA, 25 bp, Artificial sequence
  Synthetic oligonucleotide
cattcgctacggcatgacccgtaac

SEQ ID NO: 722043 - DNA, 25 bp, Artificial sequence
  Synthetic oligonucleotide
gctacggcatgacccgtaactgggt

SEQ ID NO: 722044 - DNA, 25 bp, Artificial sequence
  Synthetic oligonucleotide
gcatgacccgtaactgggtggccgg

SEQ ID NO: 722045 - DNA, 25 bp, Artificial sequence
  Synthetic oligonucleotide
ccgtaactgggtggccgggatgaag

SEQ ID NO: 722046 - DNA, 25 bp, Artificial sequence
  Synthetic oligonucleotide
atcggcggcaatatcggcaccaatg

SEQ ID NO: 722047 - DNA, 25 bp, Artificial sequence
  Synthetic oligonucleotide
ggccgggatgaaggtcgtcaccggc

SEQ ID NO: 722048 - DNA, 25 bp, Artificial sequence
  Synthetic oligonucleotide
agccagatcggcggcaatatcggca

SEQ ID NO: 722049 - DNA, 25 bp, Artificial sequence
  Synthetic oligonucleotide
ggtcgtcaccggcaagggcgacctg

SEQ ID NO: 722050 - DNA, 25 bp, Artificial sequence
  Synthetic oligonucleotide
accggcaagggcgacctgctcgagc

SEQ ID NO: 722051 - DNA, 25 bp, Artificial sequence
  Synthetic oligonucleotide
aagggcgacctgctcgagctgaaca

SEQ ID NO: 722052 - DNA, 25 bp, Artificial sequence
  Synthetic oligonucleotide
gacctgctcgagctgaacaaggacc

SEQ ID NO: 722053 - DNA, 25 bp, Artificial sequence
  Synthetic oligonucleotide
ctcgagctgaacaaggacctgatca

SEQ ID NO: 722054 - DNA, 25 bp, Artificial sequence
  Synthetic oligonucleotide
ctgaacaaggacctgatcaagaacg

SEQ ID NO: 722055 - DNA, 25 bp, Artificial sequence
  Synthetic oligonucleotide
aaggacctgatcaagaacgccaccg

SEQ ID NO: 722056 - DNA, 25 bp, Artificial sequence
  Synthetic oligonucleotide
tgatcaagaacgccaccggctacga

SEQ ID NO: 722057 - DNA, 25 bp, Artificial sequence
  Synthetic oligonucleotide
agaacgccaccggctacgacatgcg

SEQ ID NO: 722058 - DNA, 25 bp, Artificial sequence
  Synthetic oligonucleotide
cttttccttgcccggttgcgacctg

SEQ ID NO: 722059 - DNA, 25 bp, Artificial sequence
  Synthetic oligonucleotide
ctgggtggccgggatgaaggtcgtc

SEQ ID NO: 722060 - DNA, 25 bp, Artificial sequence
  Synthetic oligonucleotide
ccagccgggcgtggttaccaagcaa

SEQ ID NO: 722061 - DNA, 25 bp, Artificial sequence
  Synthetic oligonucleotide
gctacgacatgcgccagctgttcat

SEQ ID NO: 722062 - DNA, 25 bp, Artificial sequence
  Synthetic oligonucleotide
tcgtggtggccttcgactacatgaa

SEQ ID NO: 722063 - DNA, 25 bp, Artificial sequence
  Synthetic oligonucleotide
tggccttcgactacatgaaccggat

SEQ ID NO: 722064 - DNA, 25 bp, Artificial sequence
  Synthetic oligonucleotide
tcgactacatgaaccggatactcga

SEQ ID NO: 722065 - DNA, 25 bp, Artificial sequence
  Synthetic oligonucleotide
acatgaaccggatactcgacttcaa

SEQ ID NO: 722066 - DNA, 25 bp, Artificial sequence
  Synthetic oligonucleotide
accggatactcgacttcaatgcctt

SEQ ID NO: 722067 - DNA, 25 bp, Artificial sequence
  Synthetic oligonucleotide
tactcgacttcaatgccttcgaccg

SEQ ID NO: 722068 - DNA, 25 bp, Artificial sequence
  Synthetic oligonucleotide
acttcaatgccttcgaccgcaccgt

SEQ ID NO: 722069 - DNA, 25 bp, Artificial sequence
  Synthetic oligonucleotide
atgccttcgaccgcaccgtagtctg

SEQ ID NO: 722070 - DNA, 25 bp, Artificial sequence
  Synthetic oligonucleotide
tcgaccgcaccgtagtctgccagcc

SEQ ID NO: 722071 - DNA, 25 bp, Artificial sequence
  Synthetic oligonucleotide
ggcaatatcggcaccaatgccggcg

SEQ ID NO: 722072 - DNA, 25 bp, Artificial sequence
  Synthetic oligonucleotide
agtctgccagccgggcgtggttacc

SEQ ID NO: 722073 - DNA, 25 bp, Artificial sequence
  Synthetic oligonucleotide
ccaacggcgaagtcgtggtggcctt

SEQ ID NO: 722074 - DNA, 25 bp, Artificial sequence
  Synthetic oligonucleotide
ggcgtggttaccaagcaactgcaga

SEQ ID NO: 722075 - DNA, 25 bp, Artificial sequence
  Synthetic oligonucleotide
gttaccaagcaactgcagaccttcg

SEQ ID NO: 722076 - DNA, 25 bp, Artificial sequence
  Synthetic oligonucleotide
aagcaactgcagaccttcgccgagg

SEQ ID NO: 722077 - DNA, 25 bp, Artificial sequence
  Synthetic oligonucleotide
actgcagaccttcgccgaggaaaac

SEQ ID NO: 722078 - DNA, 25 bp, Artificial sequence
  Synthetic oligonucleotide
tcgccgaggaaaacggcctgtacta

SEQ ID NO: 722079 - DNA, 25 bp, Artificial sequence
  Synthetic oligonucleotide
gcctgtactacccggttgacttcgc

SEQ ID NO: 722080 - DNA, 25 bp, Artificial sequence
  Synthetic oligonucleotide
gttgacttcgcttcttccggttcca

SEQ ID NO: 722081 - DNA, 25 bp, Artificial sequence
  Synthetic oligonucleotide
tcgcttcttccggttccagccagat

SEQ ID NO: 722082 - DNA, 25 bp, Artificial sequence
  Synthetic oligonucleotide
tcttccggttccagccagatcggcg

SEQ ID NO: 722083 - DNA, 25 bp, Artificial sequence
  Synthetic oligonucleotide
ggttccagccagatcggcggcaata

SEQ ID NO: 722084 - DNA, 25 bp, Artificial sequence
  Synthetic oligonucleotide
gcaccgtagtctgccagccgggcgt

SEQ ID NO: 722085 - DNA, 25 bp, Artificial sequence
  Synthetic oligonucleotide
ttctccagcgccgcgttcagcgcct

SEQ ID NO: 722086 - DNA, 25 bp, Artificial sequence
  Synthetic oligonucleotide
tcacttcggcggctggctgacgtcc

SEQ ID NO: 722087 - DNA, 25 bp, Artificial sequence
  Synthetic oligonucleotide
tcggcggctggctgacgtccaggcc

SEQ ID NO: 722088 - DNA, 25 bp, Artificial sequence
  Synthetic oligonucleotide
gctggctgacgtccaggccgaacca

SEQ ID NO: 722089 - DNA, 25 bp, Artificial sequence
  Synthetic oligonucleotide
tgacgtccaggccgaaccacttttc

SEQ ID NO: 722090 - DNA, 25 bp, Artificial sequence
  Synthetic oligonucleotide
ccaggccgaaccacttttccgagag

SEQ ID NO: 722091 - DNA, 25 bp, Artificial sequence
  Synthetic oligonucleotide
cgaaccacttttccgagagcttggc

SEQ ID NO: 722092 - DNA, 25 bp, Artificial sequence
  Synthetic oligonucleotide
acttttccgagagcttggcgaagcg

SEQ ID NO: 722093 - DNA, 25 bp, Artificial sequence
  Synthetic oligonucleotide
cgagagcttggcgaagcggccgtcg

SEQ ID NO: 722094 - DNA, 25 bp, Artificial sequence
  Synthetic oligonucleotide
cttggcgaagcggccgtcggccttg

SEQ ID NO: 722095 - DNA, 25 bp, Artificial sequence
  Synthetic oligonucleotide
cggtcccaccgccgcgccgggcttg

SEQ ID NO: 722096 - DNA, 25 bp, Artificial sequence
  Synthetic oligonucleotide
ttgatcttctccagcgccgcgttca

SEQ ID NO: 722097 - DNA, 25 bp, Artificial sequence
  Synthetic oligonucleotide
ctctcgggcgcggccgcttcccccg

SEQ ID NO: 722098 - DNA, 25 bp, Artificial sequence
  Synthetic oligonucleotide
agcgccgcgttcagcgcctcgccga

SEQ ID NO: 722099 - DNA, 25 bp, Artificial sequence
  Synthetic oligonucleotide
gcgttcagcgcctcgccgaacttcg

SEQ ID NO: 722100 - DNA, 25 bp, Artificial sequence
  Synthetic oligonucleotide
agcgcctcgccgaacttcggattgt

SEQ ID NO: 722101 - DNA, 25 bp, Artificial sequence
  Synthetic oligonucleotide
tcgccgaacttcggattgttcttcc

SEQ ID NO: 722102 - DNA, 25 bp, Artificial sequence
  Synthetic oligonucleotide
gattgttcttccggtagggaatcgc

SEQ ID NO: 722103 - DNA, 25 bp, Artificial sequence
  Synthetic oligonucleotide
tcttccggtagggaatcgccatgtt

SEQ ID NO: 722104 - DNA, 25 bp, Artificial sequence
  Synthetic oligonucleotide
ggtagggaatcgccatgttcgccac

SEQ ID NO: 722105 - DNA, 25 bp, Artificial sequence
  Synthetic oligonucleotide
ggaatcgccatgttcgccaccggtc

SEQ ID NO: 722106 - DNA, 25 bp, Artificial sequence
  Synthetic oligonucleotide
gccatgttcgccaccggtcccaccg

SEQ ID NO: 722107 - DNA, 25 bp, Artificial sequence
  Synthetic oligonucleotide
gctgaagtcgaagaccttgcgccgc

SEQ ID NO: 722108 - DNA, 25 bp, Artificial sequence
  Synthetic oligonucleotide
ggccgtcggccttgatcttctccag

SEQ ID NO: 722109 - DNA, 25 bp, Artificial sequence
  Synthetic oligonucleotide
tcgagcaatttctgcagcgaattca

SEQ ID NO: 722110 - DNA, 25 bp, Artificial sequence
  Synthetic oligonucleotide
acggtatacatcgcgccctggagca

SEQ ID NO: 722111 - DNA, 25 bp, Artificial sequence
  Synthetic oligonucleotide
tacatcgcgccctggagcaggaagg

SEQ ID NO: 722112 - DNA, 25 bp, Artificial sequence
  Synthetic oligonucleotide
gcgccctggagcaggaagggccagg

SEQ ID NO: 722113 - DNA, 25 bp, Artificial sequence
  Synthetic oligonucleotide
ctggagcaggaagggccaggccatc

SEQ ID NO: 722114 - DNA, 25 bp, Artificial sequence
  Synthetic oligonucleotide
gcaggaagggccaggccatcccgag

SEQ ID NO: 722115 - DNA, 25 bp, Artificial sequence
  Synthetic oligonucleotide
aagggccaggccatcccgagcagct

SEQ ID NO: 722116 - DNA, 25 bp, Artificial sequence
  Synthetic oligonucleotide
aggccatcccgagcagctcgaccag

SEQ ID NO: 722117 - DNA, 25 bp, Artificial sequence
  Synthetic oligonucleotide
tcccgagcagctcgaccaggttggc

SEQ ID NO: 722118 - DNA, 25 bp, Artificial sequence
  Synthetic oligonucleotide
gcagctcgaccaggttggcgagcca

SEQ ID NO: 722119 - DNA, 25 bp, Artificial sequence
  Synthetic oligonucleotide
gaccaggttggcgagccattcgagc

SEQ ID NO: 722120 - DNA, 25 bp, Artificial sequence
  Synthetic oligonucleotide
gggaactcacttcggcggctggctg

SEQ ID NO: 722121 - DNA, 25 bp, Artificial sequence
  Synthetic oligonucleotide
gagccattcgagcaatttctgcagc

SEQ ID NO: 722122 - DNA, 25 bp, Artificial sequence
  Synthetic oligonucleotide
tcgggcgggaactcacttcggcggc

SEQ ID NO: 722123 - DNA, 25 bp, Artificial sequence
  Synthetic oligonucleotide
aatttctgcagcgaattcattcaac

SEQ ID NO: 722124 - DNA, 25 bp, Artificial sequence
  Synthetic oligonucleotide
tgcagcgaattcattcaacactcca

SEQ ID NO: 722125 - DNA, 25 bp, Artificial sequence
  Synthetic oligonucleotide
gaattcattcaacactccatcgaca

SEQ ID NO: 722126 - DNA, 25 bp, Artificial sequence
  Synthetic oligonucleotide
attcaacactccatcgacaaacacg

SEQ ID NO: 722127 - DNA, 25 bp, Artificial sequence
  Synthetic oligonucleotide
cactccatcgacaaacacgacggcc

SEQ ID NO: 722128 - DNA, 25 bp, Artificial sequence
  Synthetic oligonucleotide
atcgacaaacacgacggccgcgtct

SEQ ID NO: 722129 - DNA, 25 bp, Artificial sequence
  Synthetic oligonucleotide
aaacacgacggccgcgtctctcggg

SEQ ID NO: 722130 - DNA, 25 bp, Artificial sequence
  Synthetic oligonucleotide
gacggccgcgtctctcgggcgcggc

SEQ ID NO: 722131 - DNA, 25 bp, Artificial sequence
  Synthetic oligonucleotide
cgcgtctctcgggcgcggccgcttc

SEQ ID NO: 722132 - DNA, 25 bp, Artificial sequence
  Synthetic oligonucleotide
accgccgcgccgggcttgaccggca

SEQ ID NO: 722133 - DNA, 25 bp, Artificial sequence
  Synthetic oligonucleotide
gttggcgagccattcgagcaatttc

SEQ ID NO: 722134 - DNA, 25 bp, Artificial sequence
  Synthetic oligonucleotide
cgacttgaactggcgggtttcgtcg

SEQ ID NO: 722135 - DNA, 25 bp, Artificial sequence
  Synthetic oligonucleotide
ttcgccaggtcggcgtagttggtgc

SEQ ID NO: 722136 - DNA, 25 bp, Artificial sequence
  Synthetic oligonucleotide
caggtcggcgtagttggtgccctgg

SEQ ID NO: 722137 - DNA, 25 bp, Artificial sequence
  Synthetic oligonucleotide
gcgtagttggtgccctggccgacgc

SEQ ID NO: 722138 - DNA, 25 bp, Artificial sequence
  Synthetic oligonucleotide
ttggtgccctggccgacgccgagct

SEQ ID NO: 722139 - DNA, 25 bp, Artificial sequence
  Synthetic oligonucleotide
ccctggccgacgccgagcttgaggc

SEQ ID NO: 722140 - DNA, 25 bp, Artificial sequence
  Synthetic oligonucleotide
ccgacgccgagcttgaggcccttga

SEQ ID NO: 722141 - DNA, 25 bp, Artificial sequence
  Synthetic oligonucleotide
ccgagcttgaggcccttgaggtctt

SEQ ID NO: 722142 - DNA, 25 bp, Artificial sequence
  Synthetic oligonucleotide
ttgaggcccttgaggtcttccagcg

SEQ ID NO: 722143 - DNA, 25 bp, Artificial sequence
  Synthetic oligonucleotide
cccttgaggtcttccagcgacttga

SEQ ID NO: 722144 - DNA, 25 bp, Artificial sequence
  Synthetic oligonucleotide
ttcgccaccggtcccaccgccgcgc

SEQ ID NO: 722145 - DNA, 25 bp, Artificial sequence
  Synthetic oligonucleotide
tccagcgacttgaactggcgggttt

SEQ ID NO: 722146 - DNA, 25 bp, Artificial sequence
  Synthetic oligonucleotide
ttgacgccggccaccgacttcgcca

SEQ ID NO: 722147 - DNA, 25 bp, Artificial sequence
  Synthetic oligonucleotide
gaactggcgggtttcgtcggcgcgc

SEQ ID NO: 722148 - DNA, 25 bp, Artificial sequence
  Synthetic oligonucleotide
ggcgggtttcgtcggcgcgcacgat

SEQ ID NO: 722149 - DNA, 25 bp, Artificial sequence
  Synthetic oligonucleotide
tttcgtcggcgcgcacgatcaactg

SEQ ID NO: 722150 - DNA, 25 bp, Artificial sequence
  Synthetic oligonucleotide
cggcgcgcacgatcaactgggcgct

SEQ ID NO: 722151 - DNA, 25 bp, Artificial sequence
  Synthetic oligonucleotide
cacgatcaactgggcgctggagatg

SEQ ID NO: 722152 - DNA, 25 bp, Artificial sequence
  Synthetic oligonucleotide
caactgggcgctggagatggtgtat

SEQ ID NO: 722153 - DNA, 25 bp, Artificial sequence
  Synthetic oligonucleotide
ggcgctggagatggtgtatggctcg

SEQ ID NO: 722154 - DNA, 25 bp, Artificial sequence
  Synthetic oligonucleotide
ggagatggtgtatggctcgctgaag

SEQ ID NO: 722155 - DNA, 25 bp, Artificial sequence
  Synthetic oligonucleotide
ggtgtatggctcgctgaagtcgaag

SEQ ID NO: 722156 - DNA, 25 bp, Artificial sequence
  Synthetic oligonucleotide
cggccttgatcttctccagcgccgc

SEQ ID NO: 722157 - DNA, 25 bp, Artificial sequence
  Synthetic oligonucleotide
aggtcttccagcgacttgaactggc

SEQ ID NO: 722158 - DNA, 25 bp, Artificial sequence
  Synthetic oligonucleotide
gtcgatgcgtttgctggccaggtcc

SEQ ID NO: 722159 - DNA, 25 bp, Artificial sequence
  Synthetic oligonucleotide
gcgccgggcttgaccggcagcttgg

SEQ ID NO: 722160 - DNA, 25 bp, Artificial sequence
  Synthetic oligonucleotide
gggcttgaccggcagcttggcctcg

SEQ ID NO: 722161 - DNA, 25 bp, Artificial sequence
  Synthetic oligonucleotide
tgaccggcagcttggcctcgcggat

SEQ ID NO: 722162 - DNA, 25 bp, Artificial sequence
  Synthetic oligonucleotide
gcagcttggcctcgcggatggcgaa

SEQ ID NO: 722163 - DNA, 25 bp, Artificial sequence
  Synthetic oligonucleotide
tggcctcgcggatggcgaaggggat

SEQ ID NO: 722164 - DNA, 25 bp, Artificial sequence
  Synthetic oligonucleotide
gcggatggcgaaggggatcagcagg

SEQ ID NO: 722165 - DNA, 25 bp, Artificial sequence
  Synthetic oligonucleotide
ggcgaaggggatcagcaggcggtcg

SEQ ID NO: 722166 - DNA, 25 bp, Artificial sequence
  Synthetic oligonucleotide
ggggatcagcaggcggtcgttgagc

SEQ ID NO: 722167 - DNA, 25 bp, Artificial sequence
  Synthetic oligonucleotide
cagcaggcggtcgttgagcgccgcg

SEQ ID NO: 722168 - DNA, 25 bp, Artificial sequence
  Synthetic oligonucleotide
ggcggtcgttgagcgccgcgtcgat

SEQ ID NO: 722169 - DNA, 25 bp, Artificial sequence
  Synthetic oligonucleotide
accgacttcgccaggtcggcgtagt

SEQ ID NO: 722170 - DNA, 25 bp, Artificial sequence
  Synthetic oligonucleotide
cgccgcgtcgatgcgtttgctggcc

SEQ ID NO: 722171 - DNA, 25 bp, Artificial sequence
  Synthetic oligonucleotide
ccggccaccgacttcgccaggtcgg

SEQ ID NO: 722172 - DNA, 25 bp, Artificial sequence
  Synthetic oligonucleotide
gcgtttgctggccaggtcctgcagg

SEQ ID NO: 722173 - DNA, 25 bp, Artificial sequence
  Synthetic oligonucleotide
gctggccaggtcctgcaggtattcc

SEQ ID NO: 722174 - DNA, 25 bp, Artificial sequence
  Synthetic oligonucleotide
aggtcctgcaggtattccggggcgc

SEQ ID NO: 722175 - DNA, 25 bp, Artificial sequence
  Synthetic oligonucleotide
gcaggtattccggggcgcccggata

SEQ ID NO: 722176 - DNA, 25 bp, Artificial sequence
  Synthetic oligonucleotide
attccggggcgcccggataggtgcg

SEQ ID NO: 722177 - DNA, 25 bp, Artificial sequence
  Synthetic oligonucleotide
gggcgcccggataggtgcgcacgtt

SEQ ID NO: 722178 - DNA, 25 bp, Artificial sequence
  Synthetic oligonucleotide
ccggataggtgcgcacgttgacgcc

SEQ ID NO: 722179 - DNA, 25 bp, Artificial sequence
  Synthetic oligonucleotide
aggtgcgcacgttgacgccggccac

SEQ ID NO: 722180 - DNA, 25 bp, Artificial sequence
  Synthetic oligonucleotide
cgcacgttgacgccggccaccgact

SEQ ID NO: 722181 - DNA, 25 bp, Artificial sequence
  Synthetic oligonucleotide
gataccgcggcgaacagcacggtat

SEQ ID NO: 722182 - DNA, 25 bp, Artificial sequence
  Synthetic oligonucleotide
gttgagcgccgcgtcgatgcgtttg

SEQ ID NO: 722183 - DNA, 25 bp, Artificial sequence
  Synthetic oligonucleotide
tgttcgacaggctcggcaccgccag

SEQ ID NO: 722184 - DNA, 25 bp, Artificial sequence
  Synthetic oligonucleotide
ccagcatcagttcggtcacggtgat

SEQ ID NO: 722185 - DNA, 25 bp, Artificial sequence
  Synthetic oligonucleotide
tcagttcggtcacggtgatcacgga

SEQ ID NO: 722186 - DNA, 25 bp, Artificial sequence
  Synthetic oligonucleotide
cggtcacggtgatcacggagatcag

SEQ ID NO: 722187 - DNA, 25 bp, Artificial sequence
  Synthetic oligonucleotide
cggtgatcacggagatcagcgaggt

SEQ ID NO: 722188 - DNA, 25 bp, Artificial sequence
  Synthetic oligonucleotide
tcacggagatcagcgaggtgtcctt

SEQ ID NO: 722189 - DNA, 25 bp, Artificial sequence
  Synthetic oligonucleotide
agatcagcgaggtgtccttgatcag

SEQ ID NO: 722190 - DNA, 25 bp, Artificial sequence
  Synthetic oligonucleotide
gcgaggtgtccttgatcaggctgat

SEQ ID NO: 722191 - DNA, 25 bp, Artificial sequence
  Synthetic oligonucleotide
tgtccttgatcaggctgatcaggct

SEQ ID NO: 722192 - DNA, 25 bp, Artificial sequence
  Synthetic oligonucleotide
tgatcaggctgatcaggctgttcga

SEQ ID NO: 722193 - DNA, 25 bp, Artificial sequence
  Synthetic oligonucleotide
aacagcacggtatacatcgcgccct

SEQ ID NO: 722194 - DNA, 25 bp, Artificial sequence
  Synthetic oligonucleotide
tcaggctgttcgacaggctcggcac

SEQ ID NO: 722195 - DNA, 25 bp, Artificial sequence
  Synthetic oligonucleotide
cgatgacctccttggtcgccagcat

SEQ ID NO: 722196 - DNA, 25 bp, Artificial sequence
  Synthetic oligonucleotide
acaggctcggcaccgccaggcgcag

SEQ ID NO: 722197 - DNA, 25 bp, Artificial sequence
  Synthetic oligonucleotide
tcggcaccgccaggcgcagggcctg

SEQ ID NO: 722198 - DNA, 25 bp, Artificial sequence
  Synthetic oligonucleotide
ccgccaggcgcagggcctgcggggt

SEQ ID NO: 722199 - DNA, 25 bp, Artificial sequence
  Synthetic oligonucleotide
ggcgcagggcctgcggggtgatgat

SEQ ID NO: 722200 - DNA, 25 bp, Artificial sequence
  Synthetic oligonucleotide
gggcctgcggggtgatgatgttcca

SEQ ID NO: 722201 - DNA, 25 bp, Artificial sequence
  Synthetic oligonucleotide
gcggggtgatgatgttccacagggt

SEQ ID NO: 722202 - DNA, 25 bp, Artificial sequence
  Synthetic oligonucleotide
tgatgatgttccacagggtctggcc

SEQ ID NO: 722203 - DNA, 25 bp, Artificial sequence
  Synthetic oligonucleotide
tgttccacagggtctggccccaggt

SEQ ID NO: 722204 - DNA, 25 bp, Artificial sequence
  Synthetic oligonucleotide
acagggtctggccccaggtcaggcc

SEQ ID NO: 722205 - DNA, 25 bp, Artificial sequence
  Synthetic oligonucleotide
tctggccccaggtcaggccgaccga

SEQ ID NO: 722206 - DNA, 25 bp, Artificial sequence
  Synthetic oligonucleotide
ggctgatcaggctgttcgacaggct

SEQ ID NO: 722207 - DNA, 25 bp, Artificial sequence
  Synthetic oligonucleotide
gaaagcagccagtagatcccggcgg

SEQ ID NO: 722208 - DNA, 25 bp, Artificial sequence
  Synthetic oligonucleotide
gccaagtgcgcgaccgtcaacaagt

SEQ ID NO: 722209 - DNA, 25 bp, Artificial sequence
  Synthetic oligonucleotide
ttcttcgccaagtgcgcgaccgtca

SEQ ID NO: 722210 - DNA, 25 bp, Artificial sequence
  Synthetic oligonucleotide
tcagcgccgcagcggcgcggtcagg

SEQ ID NO: 722211 - DNA, 25 bp, Artificial sequence
  Synthetic oligonucleotide
cgcagcggcgcggtcaggcggttct

SEQ ID NO: 722212 - DNA, 25 bp, Artificial sequence
  Synthetic oligonucleotide
ggcgcggtcaggcggttctccaggg

SEQ ID NO: 722213 - DNA, 25 bp, Artificial sequence
  Synthetic oligonucleotide
gtcaggcggttctccagggctttct

SEQ ID NO: 722214 - DNA, 25 bp, Artificial sequence
  Synthetic oligonucleotide
ggttctccagggctttctgcacacg

SEQ ID NO: 722215 - DNA, 25 bp, Artificial sequence
  Synthetic oligonucleotide
cagggctttctgcacacgctcgaag

SEQ ID NO: 722216 - DNA, 25 bp, Artificial sequence
  Synthetic oligonucleotide
tttctgcacacgctcgaagagtgcc

SEQ ID NO: 722217 - DNA, 25 bp, Artificial sequence
  Synthetic oligonucleotide
cacacgctcgaagagtgccgaaagc

SEQ ID NO: 722218 - DNA, 25 bp, Artificial sequence
  Synthetic oligonucleotide
ggtcgccagcatcagttcggtcacg

SEQ ID NO: 722219 - DNA, 25 bp, Artificial sequence
  Synthetic oligonucleotide
agtgccgaaagcagccagtagatcc

SEQ ID NO: 722220 - DNA, 25 bp, Artificial sequence
  Synthetic oligonucleotide
ctccttggtcgccagcatcagttcg

SEQ ID NO: 722221 - DNA, 25 bp, Artificial sequence
  Synthetic oligonucleotide
agccagtagatcccggcggcggcga

SEQ ID NO: 722222 - DNA, 25 bp, Artificial sequence
  Synthetic oligonucleotide
tagatcccggcggcggcgagataga

SEQ ID NO: 722223 - DNA, 25 bp, Artificial sequence
  Synthetic oligonucleotide
ccggcggcggcgagatagagcggca

SEQ ID NO: 722224 - DNA, 25 bp, Artificial sequence
  Synthetic oligonucleotide
cggcgagatagagcggcagcggctg

SEQ ID NO: 722225 - DNA, 25 bp, Artificial sequence
  Synthetic oligonucleotide
gatagagcggcagcggctggaaggt

SEQ ID NO: 722226 - DNA, 25 bp, Artificial sequence
  Synthetic oligonucleotide
gcggcagcggctggaaggtctcggc

SEQ ID NO: 722227 - DNA, 25 bp, Artificial sequence
  Synthetic oligonucleotide
gcggctggaaggtctcggcgatgac

SEQ ID NO: 722228 - DNA, 25 bp, Artificial sequence
  Synthetic oligonucleotide
tggaaggtctcggcgatgacctcct

SEQ ID NO: 722229 - DNA, 25 bp, Artificial sequence
  Synthetic oligonucleotide
gtctcggcgatgacctccttggtcg

SEQ ID NO: 722230 - DNA, 25 bp, Artificial sequence
  Synthetic oligonucleotide
gaccgagagcccggcttcccattgt

SEQ ID NO: 722231 - DNA, 25 bp, Artificial sequence
  Synthetic oligonucleotide
tcgaagagtgccgaaagcagccagt

SEQ ID NO: 722232 - DNA, 25 bp, Artificial sequence
  Synthetic oligonucleotide
gcaccttggtcacccggaccaccgc

SEQ ID NO: 722233 - DNA, 25 bp, Artificial sequence
  Synthetic oligonucleotide
ccaggtcaggccgaccgagagcccg

SEQ ID NO: 722234 - DNA, 25 bp, Artificial sequence
  Synthetic oligonucleotide
gacgaagatctgcaccagcagtggc

SEQ ID NO: 722235 - DNA, 25 bp, Artificial sequence
  Synthetic oligonucleotide
gatctgcaccagcagtggcgtcccg

SEQ ID NO: 722236 - DNA, 25 bp, Artificial sequence
  Synthetic oligonucleotide
accagcagtggcgtcccgcggaagg

SEQ ID NO: 722237 - DNA, 25 bp, Artificial sequence
  Synthetic oligonucleotide
cagtggcgtcccgcggaaggcgctg

SEQ ID NO: 722238 - DNA, 25 bp, Artificial sequence
  Synthetic oligonucleotide
cgtcccgcggaaggcgctgacgtag

SEQ ID NO: 722239 - DNA, 25 bp, Artificial sequence
  Synthetic oligonucleotide
gcggaaggcgctgacgtagaccgcg

SEQ ID NO: 722240 - DNA, 25 bp, Artificial sequence
  Synthetic oligonucleotide
gcgctgacgtagaccgcggcgatct

SEQ ID NO: 722241 - DNA, 25 bp, Artificial sequence
  Synthetic oligonucleotide
acgtagaccgcggcgatctgcgaga

SEQ ID NO: 722242 - DNA, 25 bp, Artificial sequence
  Synthetic oligonucleotide
accgcggcgatctgcgagaccaccg

SEQ ID NO: 722243 - DNA, 25 bp, Artificial sequence
  Synthetic oligonucleotide
cccgtagtacaggacgaagatctgc

SEQ ID NO: 722244 - DNA, 25 bp, Artificial sequence
  Synthetic oligonucleotide
tgcgagaccaccggcaccttggtca

SEQ ID NO: 722245 - DNA, 25 bp, Artificial sequence
  Synthetic oligonucleotide
cggcagcccgtagtacaggacgaag

SEQ ID NO: 722246 - DNA, 25 bp, Artificial sequence
  Synthetic oligonucleotide
tggtcacccggaccaccgcgacgct

SEQ ID NO: 722247 - DNA, 25 bp, Artificial sequence
  Synthetic oligonucleotide
acccggaccaccgcgacgctgaagc

SEQ ID NO: 722248 - DNA, 25 bp, Artificial sequence
  Synthetic oligonucleotide
accaccgcgacgctgaagccgagga

SEQ ID NO: 722249 - DNA, 25 bp, Artificial sequence
  Synthetic oligonucleotide
gcgacgctgaagccgaggatcaggc

SEQ ID NO: 722250 - DNA, 25 bp, Artificial sequence
  Synthetic oligonucleotide
ctgaagccgaggatcaggcccagga

SEQ ID NO: 722251 - DNA, 25 bp, Artificial sequence
  Synthetic oligonucleotide
ccgaggatcaggcccaggaccatcg

SEQ ID NO: 722252 - DNA, 25 bp, Artificial sequence
  Synthetic oligonucleotide
atcaggcccaggaccatcgataccg

SEQ ID NO: 722253 - DNA, 25 bp, Artificial sequence
  Synthetic oligonucleotide
ccaggaccatcgataccgcggcgaa

SEQ ID NO: 722254 - DNA, 25 bp, Artificial sequence
  Synthetic oligonucleotide
accatcgataccgcggcgaacagca

SEQ ID NO: 722255 - DNA, 25 bp, Artificial sequence
  Synthetic oligonucleotide
agtcgaagaccttgcgccgctgctc

SEQ ID NO: 722256 - DNA, 25 bp, Artificial sequence
  Synthetic oligonucleotide
gcgatctgcgagaccaccggcacct

SEQ ID NO: 722257 - DNA, 25 bp, Artificial sequence
  Synthetic oligonucleotide
aggccgcgacattcagggtcagcgc

SEQ ID NO: 722258 - DNA, 25 bp, Artificial sequence
  Synthetic oligonucleotide
gcggcgaacagcacggtatacatcg

SEQ ID NO: 722259 - DNA, 25 bp, Artificial sequence
  Synthetic oligonucleotide
agcccggcttcccattgtcccttgt

SEQ ID NO: 722260 - DNA, 25 bp, Artificial sequence
  Synthetic oligonucleotide
gcttcccattgtcccttgtcgatgc

SEQ ID NO: 722261 - DNA, 25 bp, Artificial sequence
  Synthetic oligonucleotide
cattgtcccttgtcgatgccgagga

SEQ ID NO: 722262 - DNA, 25 bp, Artificial sequence
  Synthetic oligonucleotide
tcccttgtcgatgccgaggatcgcc

SEQ ID NO: 722263 - DNA, 25 bp, Artificial sequence
  Synthetic oligonucleotide
gtcgatgccgaggatcgccccgcgc

SEQ ID NO: 722264 - DNA, 25 bp, Artificial sequence
  Synthetic oligonucleotide
tgccgaggatcgccccgcgcatgga

SEQ ID NO: 722265 - DNA, 25 bp, Artificial sequence
  Synthetic oligonucleotide
ggatcgccccgcgcatggactccga

SEQ ID NO: 722266 - DNA, 25 bp, Artificial sequence
  Synthetic oligonucleotide
ccccgcgcatggactccgagagata

SEQ ID NO: 722267 - DNA, 25 bp, Artificial sequence
  Synthetic oligonucleotide
gcatggactccgagagataggccgc

SEQ ID NO: 722268 - DNA, 25 bp, Artificial sequence
  Synthetic oligonucleotide
gtacaggacgaagatctgcaccagc

SEQ ID NO: 722269 - DNA, 25 bp, Artificial sequence
  Synthetic oligonucleotide
gagataggccgcgacattcagggtc

SEQ ID NO: 722270 - DNA, 25 bp, Artificial sequence
  Synthetic oligonucleotide
caggccgaccgagagcccggcttcc

SEQ ID NO: 722271 - DNA, 25 bp, Artificial sequence
  Synthetic oligonucleotide
cgacattcagggtcagcgccaggat

SEQ ID NO: 722272 - DNA, 25 bp, Artificial sequence
  Synthetic oligonucleotide
ttcagggtcagcgccaggatgcccg

SEQ ID NO: 722273 - DNA, 25 bp, Artificial sequence
  Synthetic oligonucleotide
tcagcgccaggatgcccgcggtgac

SEQ ID NO: 722274 - DNA, 25 bp, Artificial sequence
  Synthetic oligonucleotide
ccaggatgcccgcggtgaccggggt

SEQ ID NO: 722275 - DNA, 25 bp, Artificial sequence
  Synthetic oligonucleotide
tgcccgcggtgaccggggtgaactc

SEQ ID NO: 722276 - DNA, 25 bp, Artificial sequence
  Synthetic oligonucleotide
cggtgaccggggtgaactcgatgcc

SEQ ID NO: 722277 - DNA, 25 bp, Artificial sequence
  Synthetic oligonucleotide
ccggggtgaactcgatgcctacgct

SEQ ID NO: 722278 - DNA, 25 bp, Artificial sequence
  Synthetic oligonucleotide
tgaactcgatgcctacgctcggcag

SEQ ID NO: 722279 - DNA, 25 bp, Artificial sequence
  Synthetic oligonucleotide
gatgcctacgctcggcagcccgtag

SEQ ID NO: 722280 - DNA, 25 bp, Artificial sequence
  Synthetic oligonucleotide
tacgctcggcagcccgtagtacagg

SEQ ID NO: 722281 - DNA, 25 bp, Artificial sequence
  Synthetic oligonucleotide
actccgagagataggccgcgacatt

SEQ ID NO: 722282 - DNA, 25 bp, Artificial sequence
  Synthetic oligonucleotide
acctgaaggagcagccggcgatgaa

SEQ ID NO: 722283 - DNA, 25 bp, Artificial sequence
  Synthetic oligonucleotide
tgaaaggcatgggcgtggcgccggc

SEQ ID NO: 722284 - DNA, 25 bp, Artificial sequence
  Synthetic oligonucleotide
gcatgggcgtggcgccggccggcgt

SEQ ID NO: 722285 - DNA, 25 bp, Artificial sequence
  Synthetic oligonucleotide
gcgtggcgccggccggcgtcgacat

SEQ ID NO: 722286 - DNA, 25 bp, Artificial sequence
  Synthetic oligonucleotide
gccggccggcgtcgacatgccggat

SEQ ID NO: 722287 - DNA, 25 bp, Artificial sequence
  Synthetic oligonucleotide
cggcgtcgacatgccggataccggc

SEQ ID NO: 722288 - DNA, 25 bp, Artificial sequence
  Synthetic oligonucleotide
cgacatgccggataccggccaccat

SEQ ID NO: 722289 - DNA, 25 bp, Artificial sequence
  Synthetic oligonucleotide
ccggataccggccaccatcacctgt

SEQ ID NO: 722290 - DNA, 25 bp, Artificial sequence
  Synthetic oligonucleotide
accggccaccatcacctgttggtgg

SEQ ID NO: 722291 - DNA, 25 bp, Artificial sequence
  Synthetic oligonucleotide
caccatcacctgttggtggacctga

SEQ ID NO: 722292 - DNA, 25 bp, Artificial sequence
  Synthetic oligonucleotide
gggccagaccgaaaccgagatcacc

SEQ ID NO: 722293 - DNA, 25 bp, Artificial sequence
  Synthetic oligonucleotide
ttggtggacctgaaggagcagccgg

SEQ ID NO: 722294 - DNA, 25 bp, Artificial sequence
  Synthetic oligonucleotide
tcaccgtgaaattcggcctgaaagg

SEQ ID NO: 722295 - DNA, 25 bp, Artificial sequence
  Synthetic oligonucleotide
ggagcagccggcgatgaacctgccg

SEQ ID NO: 722296 - DNA, 25 bp, Artificial sequence
  Synthetic oligonucleotide
agccggcgatgaacctgccgctgcc

SEQ ID NO: 722297 - DNA, 25 bp, Artificial sequence
  Synthetic oligonucleotide
cgatgaacctgccgctgccgatgac

SEQ ID NO: 722298 - DNA, 25 bp, Artificial sequence
  Synthetic oligonucleotide
acctgccgctgccgatgaccgacaa

SEQ ID NO: 722299 - DNA, 25 bp, Artificial sequence
  Synthetic oligonucleotide
cgctgccgatgaccgacaacatccg

SEQ ID NO: 722300 - DNA, 25 bp, Artificial sequence
  Synthetic oligonucleotide
cgatgaccgacaacatccgccactt

SEQ ID NO: 722301 - DNA, 25 bp, Artificial sequence
  Synthetic oligonucleotide
cgacaacatccgccacttcggcaag

SEQ ID NO: 722302 - DNA, 25 bp, Artificial sequence
  Synthetic oligonucleotide
catccgccacttcggcaagggccag

SEQ ID NO: 722303 - DNA, 25 bp, Artificial sequence
  Synthetic oligonucleotide
ccacttcggcaagggccagaccgaa

SEQ ID NO: 722304 - DNA, 25 bp, Artificial sequence
  Synthetic oligonucleotide
tggctcgctgaagtcgaagaccttg

SEQ ID NO: 722305 - DNA, 25 bp, Artificial sequence
  Synthetic oligonucleotide
cacctgttggtggacctgaaggagc

SEQ ID NO: 722306 - DNA, 25 bp, Artificial sequence
  Synthetic oligonucleotide
ccgaaggggcgaaagtgtatttcat

SEQ ID NO: 722307 - DNA, 25 bp, Artificial sequence
  Synthetic oligonucleotide
tgacattgccttgcctcggtctagc

SEQ ID NO: 722308 - DNA, 25 bp, Artificial sequence
  Synthetic oligonucleotide
tgccttgcctcggtctagccgccct

SEQ ID NO: 722309 - DNA, 25 bp, Artificial sequence
  Synthetic oligonucleotide
gcctcggtctagccgccctgatgtt

SEQ ID NO: 722310 - DNA, 25 bp, Artificial sequence
  Synthetic oligonucleotide
gtctagccgccctgatgttcggcgc

SEQ ID NO: 722311 - DNA, 25 bp, Artificial sequence
  Synthetic oligonucleotide
ccgccctgatgttcggcgcatccgc

SEQ ID NO: 722312 - DNA, 25 bp, Artificial sequence
  Synthetic oligonucleotide
tgatgttcggcgcatccgccagcct

SEQ ID NO: 722313 - DNA, 25 bp, Artificial sequence
  Synthetic oligonucleotide
cggcgcatccgccagcctgatggct

SEQ ID NO: 722314 - DNA, 25 bp, Artificial sequence
  Synthetic oligonucleotide
atccgccagcctgatggctgccgac

SEQ ID NO: 722315 - DNA, 25 bp, Artificial sequence
  Synthetic oligonucleotide
ccagcctgatggctgccgacctgcc

SEQ ID NO: 722316 - DNA, 25 bp, Artificial sequence
  Synthetic oligonucleotide
tgatggctgccgacctgccccggac

SEQ ID NO: 722317 - DNA, 25 bp, Artificial sequence
  Synthetic oligonucleotide
tcggcctgaaaggcatgggcgtggc

SEQ ID NO: 722318 - DNA, 25 bp, Artificial sequence
  Synthetic oligonucleotide
ctgccccggacgaaggcgcccgaag

SEQ ID NO: 722319 - DNA, 25 bp, Artificial sequence
  Synthetic oligonucleotide
tgaaattcggcctgaaaggcatggg

SEQ ID NO: 722320 - DNA, 25 bp, Artificial sequence
  Synthetic oligonucleotide
gggcgaaagtgtatttcatcacgcc

SEQ ID NO: 722321 - DNA, 25 bp, Artificial sequence
  Synthetic oligonucleotide
aagtgtatttcatcacgccggccga

SEQ ID NO: 722322 - DNA, 25 bp, Artificial sequence
  Synthetic oligonucleotide
atttcatcacgccggccgatggtgc

SEQ ID NO: 722323 - DNA, 25 bp, Artificial sequence
  Synthetic oligonucleotide
tcacgccggccgatggtgcaaccgt

SEQ ID NO: 722324 - DNA, 25 bp, Artificial sequence
  Synthetic oligonucleotide
cggccgatggtgcaaccgtcgacaa

SEQ ID NO: 722325 - DNA, 25 bp, Artificial sequence
  Synthetic oligonucleotide
atggtgcaaccgtcgacaagacctt

SEQ ID NO: 722326 - DNA, 25 bp, Artificial sequence
  Synthetic oligonucleotide
caaccgtcgacaagaccttcaccgt

SEQ ID NO: 722327 - DNA, 25 bp, Artificial sequence
  Synthetic oligonucleotide
tcgacaagaccttcaccgtgaaatt

SEQ ID NO: 722328 - DNA, 25 bp, Artificial sequence
  Synthetic oligonucleotide
agaccttcaccgtgaaattcggcct

SEQ ID NO: 722329 - DNA, 25 bp, Artificial sequence
  Synthetic oligonucleotide
gaccgaaaccgagatcaccctgccg

SEQ ID NO: 722330 - DNA, 25 bp, Artificial sequence
  Synthetic oligonucleotide
ctgccgacctgccccggacgaaggc

SEQ ID NO: 722331 - DNA, 25 bp, Artificial sequence
  Synthetic oligonucleotide
tagccgaccttctcgttggtttgca

SEQ ID NO: 722332 - DNA, 25 bp, Artificial sequence
  Synthetic oligonucleotide
accgttgacctgctggagtttctcc

SEQ ID NO: 722333 - DNA, 25 bp, Artificial sequence
  Synthetic oligonucleotide
gacctgctggagtttctccagggcc

SEQ ID NO: 722334 - DNA, 25 bp, Artificial sequence
  Synthetic oligonucleotide
ctggagtttctccagggccaggtcc

SEQ ID NO: 722335 - DNA, 25 bp, Artificial sequence
  Synthetic oligonucleotide
tttctccagggccaggtccgagtac

SEQ ID NO: 722336 - DNA, 25 bp, Artificial sequence
  Synthetic oligonucleotide
agggccaggtccgagtactcggcat

SEQ ID NO: 722337 - DNA, 25 bp, Artificial sequence
  Synthetic oligonucleotide
ggtccgagtactcggcatcgacgtc

SEQ ID NO: 722338 - DNA, 25 bp, Artificial sequence
  Synthetic oligonucleotide
agtactcggcatcgacgtcgatcac

SEQ ID NO: 722339 - DNA, 25 bp, Artificial sequence
  Synthetic oligonucleotide
cggcatcgacgtcgatcactacgta

SEQ ID NO: 722340 - DNA, 25 bp, Artificial sequence
  Synthetic oligonucleotide
cgacgtcgatcactacgtagccgac

SEQ ID NO: 722341 - DNA, 25 bp, Artificial sequence
  Synthetic oligonucleotide
cggcaagggccagaccgaaaccgag

SEQ ID NO: 722342 - DNA, 25 bp, Artificial sequence
  Synthetic oligonucleotide
actacgtagccgaccttctcgttgg

SEQ ID NO: 722343 - DNA, 25 bp, Artificial sequence
  Synthetic oligonucleotide
gcacgcggctacggatggtaccgtt

SEQ ID NO: 722344 - DNA, 25 bp, Artificial sequence
  Synthetic oligonucleotide
accttctcgttggtttgcaggtact

SEQ ID NO: 722345 - DNA, 25 bp, Artificial sequence
  Synthetic oligonucleotide
tcgttggtttgcaggtactggccgg

SEQ ID NO: 722346 - DNA, 25 bp, Artificial sequence
  Synthetic oligonucleotide
ttgcaggtactggccggaaacgttg

SEQ ID NO: 722347 - DNA, 25 bp, Artificial sequence
  Synthetic oligonucleotide
gtactggccggaaacgttgatgccg

SEQ ID NO: 722348 - DNA, 25 bp, Artificial sequence
  Synthetic oligonucleotide
gccggaaacgttgatgccgttgtcg

SEQ ID NO: 722349 - DNA, 25 bp, Artificial sequence
  Synthetic oligonucleotide
aacgttgatgccgttgtcggcgaag

SEQ ID NO: 722350 - DNA, 25 bp, Artificial sequence
  Synthetic oligonucleotide
gatgccgttgtcggcgaagaccttg

SEQ ID NO: 722351 - DNA, 25 bp, Artificial sequence
  Synthetic oligonucleotide
gttgtcggcgaagaccttgttgatc

SEQ ID NO: 722352 - DNA, 25 bp, Artificial sequence
  Synthetic oligonucleotide
ggcgaagaccttgttgatctcgctc

SEQ ID NO: 722353 - DNA, 25 bp, Artificial sequence
  Synthetic oligonucleotide
gaccttgttgatctcgctcatcacg

SEQ ID NO: 722354 - DNA, 25 bp, Artificial sequence
  Synthetic oligonucleotide
tcgatcactacgtagccgaccttct

SEQ ID NO: 722355 - DNA, 25 bp, Artificial sequence
  Synthetic oligonucleotide
ggagccgaccgtggagtcggagaag

SEQ ID NO: 722356 - DNA, 25 bp, Artificial sequence
  Synthetic oligonucleotide
aaaccgagatcaccctgccgccggg

SEQ ID NO: 722357 - DNA, 25 bp, Artificial sequence
  Synthetic oligonucleotide
agatcaccctgccgccgggcaagca

SEQ ID NO: 722358 - DNA, 25 bp, Artificial sequence
  Synthetic oligonucleotide
ccctgccgccgggcaagcacaccct

SEQ ID NO: 722359 - DNA, 25 bp, Artificial sequence
  Synthetic oligonucleotide
cgccgggcaagcacaccctgcaact

SEQ ID NO: 722360 - DNA, 25 bp, Artificial sequence
  Synthetic oligonucleotide
gcaagcacaccctgcaactgctggt

SEQ ID NO: 722361 - DNA, 25 bp, Artificial sequence
  Synthetic oligonucleotide
acaccctgcaactgctggtgggcga

SEQ ID NO: 722362 - DNA, 25 bp, Artificial sequence
  Synthetic oligonucleotide
tgcaactgctggtgggcgacaagaa

SEQ ID NO: 722363 - DNA, 25 bp, Artificial sequence
  Synthetic oligonucleotide
tgctggtgggcgacaagaaccacgt

SEQ ID NO: 722364 - DNA, 25 bp, Artificial sequence
  Synthetic oligonucleotide
tgggcgacaagaaccacgtgccgct

SEQ ID NO: 722365 - DNA, 25 bp, Artificial sequence
  Synthetic oligonucleotide
acaagaaccacgtgccgctggagcc

SEQ ID NO: 722366 - DNA, 25 bp, Artificial sequence
  Synthetic oligonucleotide
gatggtaccgttgacctgctggagt

SEQ ID NO: 722367 - DNA, 25 bp, Artificial sequence
  Synthetic oligonucleotide
gccgctggagccgaccgtggagtcg

SEQ ID NO: 722368 - DNA, 25 bp, Artificial sequence
  Synthetic oligonucleotide
ggctacggatggtaccgttgacctg

SEQ ID NO: 722369 - DNA, 25 bp, Artificial sequence
  Synthetic oligonucleotide
gaccgtggagtcggagaagatcacc

SEQ ID NO: 722370 - DNA, 25 bp, Artificial sequence
  Synthetic oligonucleotide
ggagtcggagaagatcaccgttacc

SEQ ID NO: 722371 - DNA, 25 bp, Artificial sequence
  Synthetic oligonucleotide
ggagaagatcaccgttaccgtcaag

SEQ ID NO: 722372 - DNA, 25 bp, Artificial sequence
  Synthetic oligonucleotide
gatcaccgttaccgtcaagtgacgg

SEQ ID NO: 722373 - DNA, 25 bp, Artificial sequence
  Synthetic oligonucleotide
ttcctttccgccggacgctgcctta

SEQ ID NO: 722374 - DNA, 25 bp, Artificial sequence
  Synthetic oligonucleotide
tccgccggacgctgccttagaacag

SEQ ID NO: 722375 - DNA, 25 bp, Artificial sequence
  Synthetic oligonucleotide
ggacgctgccttagaacagcacgcg

SEQ ID NO: 722376 - DNA, 25 bp, Artificial sequence
  Synthetic oligonucleotide
tgccttagaacagcacgcggctacg

SEQ ID NO: 722377 - DNA, 25 bp, Artificial sequence
  Synthetic oligonucleotide
agaacagcacgcggctacggatggt

SEQ ID NO: 722378 - DNA, 25 bp, Artificial sequence
  Synthetic oligonucleotide
ggagactcccatgagagtgacattg

SEQ ID NO: 722379 - DNA, 25 bp, Artificial sequence
  Synthetic oligonucleotide
accacgtgccgctggagccgaccgt

SEQ ID NO: 722380 - DNA, 25 bp, Artificial sequence
  Synthetic oligonucleotide
cgcagggcgccgcgctggtggacgt

SEQ ID NO: 722381 - DNA, 25 bp, Artificial sequence
  Synthetic oligonucleotide
tctcgaagccggtgagcttgccacc

SEQ ID NO: 722382 - DNA, 25 bp, Artificial sequence
  Synthetic oligonucleotide
agccggtgagcttgccaccctgctt

SEQ ID NO: 722383 - DNA, 25 bp, Artificial sequence
  Synthetic oligonucleotide
gagcttgccaccctgcttgaagttg

SEQ ID NO: 722384 - DNA, 25 bp, Artificial sequence
  Synthetic oligonucleotide
gccaccctgcttgaagttgaacggc

SEQ ID NO: 722385 - DNA, 25 bp, Artificial sequence
  Synthetic oligonucleotide
ctgcttgaagttgaacggcggatag

SEQ ID NO: 722386 - DNA, 25 bp, Artificial sequence
  Synthetic oligonucleotide
aagttgaacggcggataggtgccct

SEQ ID NO: 722387 - DNA, 25 bp, Artificial sequence
  Synthetic oligonucleotide
aacggcggataggtgccctccaggg

SEQ ID NO: 722388 - DNA, 25 bp, Artificial sequence
  Synthetic oligonucleotide
ggataggtgccctccagggcgatgc

SEQ ID NO: 722389 - DNA, 25 bp, Artificial sequence
  Synthetic oligonucleotide
gtgccctccagggcgatgcgcaggg

SEQ ID NO: 722390 - DNA, 25 bp, Artificial sequence
  Synthetic oligonucleotide
gagagtgacattgccttgcctcggt

SEQ ID NO: 722391 - DNA, 25 bp, Artificial sequence
  Synthetic oligonucleotide
gcgatgcgcagggcgccgcgctggt

SEQ ID NO: 722392 - DNA, 25 bp, Artificial sequence
  Synthetic oligonucleotide
agttcgcccagttcggtctcgaagc

SEQ ID NO: 722393 - DNA, 25 bp, Artificial sequence
  Synthetic oligonucleotide
gcgccgcgctggtggacgtcgtcga

SEQ ID NO: 722394 - DNA, 25 bp, Artificial sequence
  Synthetic oligonucleotide
cgctggtggacgtcgtcgagcagct

SEQ ID NO: 722395 - DNA, 25 bp, Artificial sequence
  Synthetic oligonucleotide
tggacgtcgtcgagcagctcggcat

SEQ ID NO: 722396 - DNA, 25 bp, Artificial sequence
  Synthetic oligonucleotide
tcgtcgagcagctcggcatgggcca

SEQ ID NO: 722397 - DNA, 25 bp, Artificial sequence
  Synthetic oligonucleotide
agcagctcggcatgggccagcggag

SEQ ID NO: 722398 - DNA, 25 bp, Artificial sequence
  Synthetic oligonucleotide
tcggcatgggccagcggagcggcca

SEQ ID NO: 722399 - DNA, 25 bp, Artificial sequence
  Synthetic oligonucleotide
tgggccagcggagcggccagggata

SEQ ID NO: 722400 - DNA, 25 bp, Artificial sequence
  Synthetic oligonucleotide
agcggagcggccagggataccagca

SEQ ID NO: 722401 - DNA, 25 bp, Artificial sequence
  Synthetic oligonucleotide
gcggccagggataccagcatcagca

SEQ ID NO: 722402 - DNA, 25 bp, Artificial sequence
  Synthetic oligonucleotide
agggataccagcatcagcaggcggg

SEQ ID NO: 722403 - DNA, 25 bp, Artificial sequence
  Synthetic oligonucleotide
tccagggcgatgcgcagggcgccgc

SEQ ID NO: 722404 - DNA, 25 bp, Artificial sequence
  Synthetic oligonucleotide
cgaggatgccgctccattcggtggt

SEQ ID NO: 722405 - DNA, 25 bp, Artificial sequence
  Synthetic oligonucleotide
aagaccttgcgccgctgctcgttca

SEQ ID NO: 722406 - DNA, 25 bp, Artificial sequence
  Synthetic oligonucleotide
ttgcgccgctgctcgttcaccgaga

SEQ ID NO: 722407 - DNA, 25 bp, Artificial sequence
  Synthetic oligonucleotide
cgctgctcgttcaccgagacctggt

SEQ ID NO: 722408 - DNA, 25 bp, Artificial sequence
  Synthetic oligonucleotide
tcgttcaccgagacctggttcagcg

SEQ ID NO: 722409 - DNA, 25 bp, Artificial sequence
  Synthetic oligonucleotide
accgagacctggttcagcgcgatgt

SEQ ID NO: 722410 - DNA, 25 bp, Artificial sequence
  Synthetic oligonucleotide
acctggttcagcgcgatgtcgtact

SEQ ID NO: 722411 - DNA, 25 bp, Artificial sequence
  Synthetic oligonucleotide
ttcagcgcgatgtcgtacttgccgc

SEQ ID NO: 722412 - DNA, 25 bp, Artificial sequence
  Synthetic oligonucleotide
cgcgatgtcgtacttgccgctctgc

SEQ ID NO: 722413 - DNA, 25 bp, Artificial sequence
  Synthetic oligonucleotide
tcgtacttgccgctctgcaggccgg

SEQ ID NO: 722414 - DNA, 25 bp, Artificial sequence
  Synthetic oligonucleotide
ttgccgctctgcaggccggcgagga

SEQ ID NO: 722415 - DNA, 25 bp, Artificial sequence
  Synthetic oligonucleotide
ttcggtctcgaagccggtgagcttg

SEQ ID NO: 722416 - DNA, 25 bp, Artificial sequence
  Synthetic oligonucleotide
aggccggcgaggatgccgctccatt

SEQ ID NO: 722417 - DNA, 25 bp, Artificial sequence
  Synthetic oligonucleotide
cccagttcggtctcgaagccggtga

SEQ ID NO: 722418 - DNA, 25 bp, Artificial sequence
  Synthetic oligonucleotide
tgccgctccattcggtggtgacgaa

SEQ ID NO: 722419 - DNA, 25 bp, Artificial sequence
  Synthetic oligonucleotide
tccattcggtggtgacgaattcagg

SEQ ID NO: 722420 - DNA, 25 bp, Artificial sequence
  Synthetic oligonucleotide
cggtggtgacgaattcaggcttgac

SEQ ID NO: 722421 - DNA, 25 bp, Artificial sequence
  Synthetic oligonucleotide
gacgaattcaggcttgaccgccagt

SEQ ID NO: 722422 - DNA, 25 bp, Artificial sequence
  Synthetic oligonucleotide
ttcaggcttgaccgccagttcggcg

SEQ ID NO: 722423 - DNA, 25 bp, Artificial sequence
  Synthetic oligonucleotide
ttgaccgccagttcggcggccagca

SEQ ID NO: 722424 - DNA, 25 bp, Artificial sequence
  Synthetic oligonucleotide
gccagttcggcggccagcagttcgc

SEQ ID NO: 722425 - DNA, 25 bp, Artificial sequence
  Synthetic oligonucleotide
tcggcggccagcagttcgcccagtt

SEQ ID NO: 722426 - DNA, 25 bp, Artificial sequence
  Synthetic oligonucleotide
gccagcagttcgcccagttcggtct

SEQ ID NO: 722427 - DNA, 25 bp, Artificial sequence
  Synthetic oligonucleotide
aggcggggcagaaatcgcatgtagt

SEQ ID NO: 722428 - DNA, 25 bp, Artificial sequence
  Synthetic oligonucleotide
gctctgcaggccggcgaggatgccg

SEQ ID NO: 722429 - DNA, 25 bp, Artificial sequence
  Synthetic oligonucleotide
tttccctgattcggaaggcacgaag

SEQ ID NO: 722430 - DNA, 25 bp, Artificial sequence
  Synthetic oligonucleotide
accagcatcagcaggcggggcagaa

SEQ ID NO: 722431 - DNA, 25 bp, Artificial sequence
  Synthetic oligonucleotide
gattatgtgcgcgagcgccgctcta

SEQ ID NO: 722432 - DNA, 25 bp, Artificial sequence
  Synthetic oligonucleotide
tgcgcgagcgccgctctaacacggg

SEQ ID NO: 722433 - DNA, 25 bp, Artificial sequence
  Synthetic oligonucleotide
gagcgccgctctaacacgggcttcg

SEQ ID NO: 722434 - DNA, 25 bp, Artificial sequence
  Synthetic oligonucleotide
cgctctaacacgggcttcgcagtgg

SEQ ID NO: 722435 - DNA, 25 bp, Artificial sequence
  Synthetic oligonucleotide
taacacgggcttcgcagtggaaatc

SEQ ID NO: 722436 - DNA, 25 bp, Artificial sequence
  Synthetic oligonucleotide
ggcttcgcagtggaaatcgctgtgc

SEQ ID NO: 722437 - DNA, 25 bp, Artificial sequence
  Synthetic oligonucleotide
gcagtggaaatcgctgtgccagcga

SEQ ID NO: 722438 - DNA, 25 bp, Artificial sequence
  Synthetic oligonucleotide
gaaatcgctgtgccagcgatgcctt

SEQ ID NO: 722439 - DNA, 25 bp, Artificial sequence
  Synthetic oligonucleotide
gctgtgccagcgatgcctttccctg

SEQ ID NO: 722440 - DNA, 25 bp, Artificial sequence
  Synthetic oligonucleotide
gggcattgacccggattatgtgcgc

SEQ ID NO: 722441 - DNA, 25 bp, Artificial sequence
  Synthetic oligonucleotide
gatgcctttccctgattcggaaggc

SEQ ID NO: 722442 - DNA, 25 bp, Artificial sequence
  Synthetic oligonucleotide
gggttgcgggcattgacccggatta

SEQ ID NO: 722443 - DNA, 25 bp, Artificial sequence
  Synthetic oligonucleotide
tgattcggaaggcacgaagagtgcc

SEQ ID NO: 722444 - DNA, 25 bp, Artificial sequence
  Synthetic oligonucleotide
ggaaggcacgaagagtgccggggaa

SEQ ID NO: 722445 - DNA, 25 bp, Artificial sequence
  Synthetic oligonucleotide
cacgaagagtgccggggaaattccg

SEQ ID NO: 722446 - DNA, 25 bp, Artificial sequence
  Synthetic oligonucleotide
agtgccggggaaattccgtccagtg

SEQ ID NO: 722447 - DNA, 25 bp, Artificial sequence
  Synthetic oligonucleotide
cgtccagtggtgtttcccgggtgct

SEQ ID NO: 722448 - DNA, 25 bp, Artificial sequence
  Synthetic oligonucleotide
cgggtgctaacggaagtgaaaacag

SEQ ID NO: 722449 - DNA, 25 bp, Artificial sequence
  Synthetic oligonucleotide
ctaacggaagtgaaaacaggagact

SEQ ID NO: 722450 - DNA, 25 bp, Artificial sequence
  Synthetic oligonucleotide
gaagtgaaaacaggagactcccatg

SEQ ID NO: 722451 - DNA, 25 bp, Artificial sequence
  Synthetic oligonucleotide
aaaacaggagactcccatgagagtg

SEQ ID NO: 722452 - DNA, 25 bp, Artificial sequence
  Synthetic oligonucleotide
tgttgatctcgctcatcacgccggg

SEQ ID NO: 722453 - DNA, 25 bp, Artificial sequence
  Synthetic oligonucleotide
gccagcgatgcctttccctgattcg

SEQ ID NO: 722454 - DNA, 25 bp, Artificial sequence
  Synthetic oligonucleotide
cagcttagccgggcccgcgtcctgg

SEQ ID NO: 722455 - DNA, 25 bp, Artificial sequence
  Synthetic oligonucleotide
tcccatgagagtgacattgccttgc

SEQ ID NO: 722456 - DNA, 25 bp, Artificial sequence
  Synthetic oligonucleotide
ggcagaaatcgcatgtagtactcct

SEQ ID NO: 722457 - DNA, 25 bp, Artificial sequence
  Synthetic oligonucleotide
aatcgcatgtagtactcctcgggtg

SEQ ID NO: 722458 - DNA, 25 bp, Artificial sequence
  Synthetic oligonucleotide
atgtagtactcctcgggtgggaatg

SEQ ID NO: 722459 - DNA, 25 bp, Artificial sequence
  Synthetic oligonucleotide
tactcctcgggtgggaatgaacgtc

SEQ ID NO: 722460 - DNA, 25 bp, Artificial sequence
  Synthetic oligonucleotide
ctcgggtgggaatgaacgtcggtcg

SEQ ID NO: 722461 - DNA, 25 bp, Artificial sequence
  Synthetic oligonucleotide
tgggaatgaacgtcggtcgggccta

SEQ ID NO: 722462 - DNA, 25 bp, Artificial sequence
  Synthetic oligonucleotide
tgaacgtcggtcgggcctatgctgt

SEQ ID NO: 722463 - DNA, 25 bp, Artificial sequence
  Synthetic oligonucleotide
tcggtcgggcctatgctgttcgttc

SEQ ID NO: 722464 - DNA, 25 bp, Artificial sequence
  Synthetic oligonucleotide
gggcctatgctgttcgttcagctta

SEQ ID NO: 722465 - DNA, 25 bp, Artificial sequence
  Synthetic oligonucleotide
tgacccggattatgtgcgcgagcgc

SEQ ID NO: 722466 - DNA, 25 bp, Artificial sequence
  Synthetic oligonucleotide
ttcgttcagcttagccgggcccgcg

SEQ ID NO: 722467 - DNA, 25 bp, Artificial sequence
  Synthetic oligonucleotide
atcagcaggcggggcagaaatcgca

SEQ ID NO: 722468 - DNA, 25 bp, Artificial sequence
  Synthetic oligonucleotide
agccgggcccgcgtcctggacaatc

SEQ ID NO: 722469 - DNA, 25 bp, Artificial sequence
  Synthetic oligonucleotide
gcccgcgtcctggacaatcgcgaac

SEQ ID NO: 722470 - DNA, 25 bp, Artificial sequence
  Synthetic oligonucleotide
gtcctggacaatcgcgaacctactg

SEQ ID NO: 722471 - DNA, 25 bp, Artificial sequence
  Synthetic oligonucleotide
gacaatcgcgaacctactgggttgc

SEQ ID NO: 722472 - DNA, 25 bp, Artificial sequence
  Synthetic oligonucleotide
cgcgaacctactgggttgcatgcgg

SEQ ID NO: 722473 - DNA, 25 bp, Artificial sequence
  Synthetic oligonucleotide
cctactgggttgcatgcggtctttc

SEQ ID NO: 722474 - DNA, 25 bp, Artificial sequence
  Synthetic oligonucleotide
tgggttgcatgcggtctttccaggg

SEQ ID NO: 722475 - DNA, 25 bp, Artificial sequence
  Synthetic oligonucleotide
tgcatgcggtctttccaggggttgc

SEQ ID NO: 722476 - DNA, 25 bp, Artificial sequence
  Synthetic oligonucleotide
cggtctttccaggggttgcgggcat

SEQ ID NO: 722477 - DNA, 25 bp, Artificial sequence
  Synthetic oligonucleotide
tttccaggggttgcgggcattgacc

SEQ ID NO: 722478 - DNA, 25 bp, Artificial sequence
  Synthetic oligonucleotide
atgctgttcgttcagcttagccggg

SEQ ID NO: 722479 - DNA, 25 bp, Artificial sequence
  Synthetic oligonucleotide
gaagaaacctcggacctggcctaca

SEQ ID NO: 722480 - DNA, 25 bp, Artificial sequence
  Synthetic oligonucleotide
gtcggctggccgacgcttcgattga

SEQ ID NO: 722481 - DNA, 25 bp, Artificial sequence
  Synthetic oligonucleotide
gcaagcggccgctgctggtggagct

SEQ ID NO: 722482 - DNA, 25 bp, Artificial sequence
  Synthetic oligonucleotide
ttaccggcaagcggccgctgctggt

SEQ ID NO: 722483 - DNA, 25 bp, Artificial sequence
  Synthetic oligonucleotide
tcaccgttaccggcaagcggccgct

SEQ ID NO: 722484 - DNA, 25 bp, Artificial sequence
  Synthetic oligonucleotide
ccctgttcaccgttaccggcaagcg

SEQ ID NO: 722485 - DNA, 25 bp, Artificial sequence
  Synthetic oligonucleotide
ccggcaaccaggaccctgttcaccg

SEQ ID NO: 722486 - DNA, 25 bp, Artificial sequence
  Synthetic oligonucleotide
ctacaacccggcaaccaggaccctg

SEQ ID NO: 722487 - DNA, 25 bp, Artificial sequence
  Synthetic oligonucleotide
gctggtggagctgtcgctcaccggc

SEQ ID NO: 722488 - DNA, 25 bp, Artificial sequence
  Synthetic oligonucleotide
ctcggacctggcctacaacccggca

SEQ ID NO: 722489 - DNA, 25 bp, Artificial sequence
  Synthetic oligonucleotide
tggagctgtcgctcaccggcgacgt

SEQ ID NO: 722490 - DNA, 25 bp, Artificial sequence
  Synthetic oligonucleotide
cagggcctggaggaggaagaaacct

SEQ ID NO: 722491 - DNA, 25 bp, Artificial sequence
  Synthetic oligonucleotide
cgttgcagggcctggaggaggaaga

SEQ ID NO: 722492 - DNA, 25 bp, Artificial sequence
  Synthetic oligonucleotide
ccaagccgttgcagggcctggagga

SEQ ID NO: 722493 - DNA, 25 bp, Artificial sequence
  Synthetic oligonucleotide
tcgacgccaagccgttgcagggcct

SEQ ID NO: 722494 - DNA, 25 bp, Artificial sequence
  Synthetic oligonucleotide
tggtgatcgacgccaagccgttgca

SEQ ID NO: 722495 - DNA, 25 bp, Artificial sequence
  Synthetic oligonucleotide
atcgggtggtgatcgacgccaagcc

SEQ ID NO: 722496 - DNA, 25 bp, Artificial sequence
  Synthetic oligonucleotide
gggctatcgggtggtgatcgacgcc

SEQ ID NO: 722497 - DNA, 25 bp, Artificial sequence
  Synthetic oligonucleotide
gctgccgggctatcgggtggtgatc

SEQ ID NO: 722498 - DNA, 25 bp, Artificial sequence
  Synthetic oligonucleotide
cctggcctacaacccggcaaccagg

SEQ ID NO: 722499 - DNA, 25 bp, Artificial sequence
  Synthetic oligonucleotide
aatcccgaaggcgtggcggtgctgg

SEQ ID NO: 722500 - DNA, 25 bp, Artificial sequence
  Synthetic oligonucleotide
gccgcaataccctgaccatcttcca

SEQ ID NO: 722501 - DNA, 25 bp, Artificial sequence
  Synthetic oligonucleotide
acgagcgccgcaataccctgaccat

SEQ ID NO: 722502 - DNA, 25 bp, Artificial sequence
  Synthetic oligonucleotide
tgaccgacgagcgccgcaataccct

SEQ ID NO: 722503 - DNA, 25 bp, Artificial sequence
  Synthetic oligonucleotide
tcgcggtgaccgacgagcgccgcaa

SEQ ID NO: 722504 - DNA, 25 bp, Artificial sequence
  Synthetic oligonucleotide
gcaacgtcgcggtgaccgacgagcg

SEQ ID NO: 722505 - DNA, 25 bp, Artificial sequence
  Synthetic oligonucleotide
agaacggcaacgtcgcggtgaccga

SEQ ID NO: 722506 - DNA, 25 bp, Artificial sequence
  Synthetic oligonucleotide
gtgctggagaacggcaacgtcgcgg

SEQ ID NO: 722507 - DNA, 25 bp, Artificial sequence
  Synthetic oligonucleotide
ggccgctgctggtggagctgtcgct

SEQ ID NO: 722508 - DNA, 25 bp, Artificial sequence
  Synthetic oligonucleotide
gaaggcgtggcggtgctggagaacg

SEQ ID NO: 722509 - DNA, 25 bp, Artificial sequence
  Synthetic oligonucleotide
cgcgacgaaagcatctggctgccgg

SEQ ID NO: 722510 - DNA, 25 bp, Artificial sequence
  Synthetic oligonucleotide
ctgagcaatcccgaaggcgtggcgg

SEQ ID NO: 722511 - DNA, 25 bp, Artificial sequence
  Synthetic oligonucleotide
ctcggcctgagcaatcccgaaggcg

SEQ ID NO: 722512 - DNA, 25 bp, Artificial sequence
  Synthetic oligonucleotide
ccgctgctcggcctgagcaatcccg

SEQ ID NO: 722513 - DNA, 25 bp, Artificial sequence
  Synthetic oligonucleotide
caccatcccgctgctcggcctgagc

SEQ ID NO: 722514 - DNA, 25 bp, Artificial sequence
  Synthetic oligonucleotide
gctgcgcaccatcccgctgctcggc

SEQ ID NO: 722515 - DNA, 25 bp, Artificial sequence
  Synthetic oligonucleotide
cgacgtgctgcgcaccatcccgctg

SEQ ID NO: 722516 - DNA, 25 bp, Artificial sequence
  Synthetic oligonucleotide
tcaccggcgacgtgctgcgcaccat

SEQ ID NO: 722517 - DNA, 25 bp, Artificial sequence
  Synthetic oligonucleotide
tgtcgctcaccggcgacgtgctgcg

SEQ ID NO: 722518 - DNA, 25 bp, Artificial sequence
  Synthetic oligonucleotide
gtggcggtgctggagaacggcaacg

SEQ ID NO: 722519 - DNA, 25 bp, Artificial sequence
  Synthetic oligonucleotide
gcccaagaaaacacctggccaaaca

SEQ ID NO: 722520 - DNA, 25 bp, Artificial sequence
  Synthetic oligonucleotide
tccccgtttccgctggctgctgccg

SEQ ID NO: 722521 - DNA, 25 bp, Artificial sequence
  Synthetic oligonucleotide
caagcttccccgtttccgctggctg

SEQ ID NO: 722522 - DNA, 25 bp, Artificial sequence
  Synthetic oligonucleotide
tgcctccaagcttccccgtttccgc

SEQ ID NO: 722523 - DNA, 25 bp, Artificial sequence
  Synthetic oligonucleotide
cccatgtcccttgcctccaagcttc

SEQ ID NO: 722524 - DNA, 25 bp, Artificial sequence
  Synthetic oligonucleotide
gcctcgcccatgtcccttgcctcca

SEQ ID NO: 722525 - DNA, 25 bp, Artificial sequence
  Synthetic oligonucleotide
agtcgagcctcgcccatgtcccttg

SEQ ID NO: 722526 - DNA, 25 bp, Artificial sequence
  Synthetic oligonucleotide
ccaaacagtcgagcctcgcccatgt

SEQ ID NO: 722527 - DNA, 25 bp, Artificial sequence
  Synthetic oligonucleotide
atctggctgccgggctatcgggtgg

SEQ ID NO: 722528 - DNA, 25 bp, Artificial sequence
  Synthetic oligonucleotide
gaaaacacctggccaaacagtcgag

SEQ ID NO: 722529 - DNA, 25 bp, Artificial sequence
  Synthetic oligonucleotide
tgctgccggcgttcgtcgtgctcgt

SEQ ID NO: 722530 - DNA, 25 bp, Artificial sequence
  Synthetic oligonucleotide
tggcgacgcccaagaaaacacctgg

SEQ ID NO: 722531 - DNA, 25 bp, Artificial sequence
  Synthetic oligonucleotide
ctttcatggcgacgcccaagaaaac

SEQ ID NO: 722532 - DNA, 25 bp, Artificial sequence
  Synthetic oligonucleotide
aatgccctttcatggcgacgcccaa

SEQ ID NO: 722533 - DNA, 25 bp, Artificial sequence
  Synthetic oligonucleotide
gggggcaatgccctttcatggcgac

SEQ ID NO: 722534 - DNA, 25 bp, Artificial sequence
  Synthetic oligonucleotide
acaggccgggggcaatgccctttca

SEQ ID NO: 722535 - DNA, 25 bp, Artificial sequence
  Synthetic oligonucleotide
cgattgacaggccgggggcaatgcc

SEQ ID NO: 722536 - DNA, 25 bp, Artificial sequence
  Synthetic oligonucleotide
acgcttcgattgacaggccgggggc

SEQ ID NO: 722537 - DNA, 25 bp, Artificial sequence
  Synthetic oligonucleotide
tggccgacgcttcgattgacaggcc

SEQ ID NO: 722538 - DNA, 25 bp, Artificial sequence
  Synthetic oligonucleotide
acctggccaaacagtcgagcctcgc

SEQ ID NO: 722539 - DNA, 25 bp, Artificial sequence
  Synthetic oligonucleotide
tgcattgggacgatcgcgccggcct

SEQ ID NO: 722540 - DNA, 25 bp, Artificial sequence
  Synthetic oligonucleotide
tcttccatgtcgacccgcagaccgc

SEQ ID NO: 722541 - DNA, 25 bp, Artificial sequence
  Synthetic oligonucleotide
agcagcgcgacgaaagcatctggct

SEQ ID NO: 722542 - DNA, 25 bp, Artificial sequence
  Synthetic oligonucleotide
gccagcagcagcgcgacgaaagcat

SEQ ID NO: 722543 - DNA, 25 bp, Artificial sequence
  Synthetic oligonucleotide
aggccagccagcagcagcgcgacga

SEQ ID NO: 722544 - DNA, 25 bp, Artificial sequence
  Synthetic oligonucleotide
aaagccaggccagccagcagcagcg

SEQ ID NO: 722545 - DNA, 25 bp, Artificial sequence
  Synthetic oligonucleotide
gaaggaaagccaggccagccagcag

SEQ ID NO: 722546 - DNA, 25 bp, Artificial sequence
  Synthetic oligonucleotide
ttggtggaaggaaagccaggccagc

SEQ ID NO: 722547 - DNA, 25 bp, Artificial sequence
  Synthetic oligonucleotide
cggcctttggtggaaggaaagccag

SEQ ID NO: 722548 - DNA, 25 bp, Artificial sequence
  Synthetic oligonucleotide
gtttccgctggctgctgccggcgtt

SEQ ID NO: 722549 - DNA, 25 bp, Artificial sequence
  Synthetic oligonucleotide
gggacgatcgcgccggcctttggtg

SEQ ID NO: 722550 - DNA, 25 bp, Artificial sequence
  Synthetic oligonucleotide
gctggctgctgccggcgttcgtcgt

SEQ ID NO: 722551 - DNA, 25 bp, Artificial sequence
  Synthetic oligonucleotide
tcgtcatgcattgggacgatcgcgc

SEQ ID NO: 722552 - DNA, 25 bp, Artificial sequence
  Synthetic oligonucleotide
tgaccatcgtcatgcattgggacga

SEQ ID NO: 722553 - DNA, 25 bp, Artificial sequence
  Synthetic oligonucleotide
tggtgctgaccatcgtcatgcattg

SEQ ID NO: 722554 - DNA, 25 bp, Artificial sequence
  Synthetic oligonucleotide
tcggcgtggtgctgaccatcgtcat

SEQ ID NO: 722555 - DNA, 25 bp, Artificial sequence
  Synthetic oligonucleotide
tgctcgtcggcgtggtgctgaccat

SEQ ID NO: 722556 - DNA, 25 bp, Artificial sequence
  Synthetic oligonucleotide
tcgtcgtgctcgtcggcgtggtgct

SEQ ID NO: 722557 - DNA, 25 bp, Artificial sequence
  Synthetic oligonucleotide
cggcgttcgtcgtgctcgtcggcgt

SEQ ID NO: 722558 - DNA, 25 bp, Artificial sequence
  Synthetic oligonucleotide
gaaagcatctggctgccgggctatc

SEQ ID NO: 722559 - DNA, 25 bp, Artificial sequence
  Synthetic oligonucleotide
atcgcgccggcctttggtggaagga

SEQ ID NO: 722560 - DNA, 25 bp, Artificial sequence
  Synthetic oligonucleotide
ctgctggagctggacgagaagggcg

SEQ ID NO: 722561 - DNA, 25 bp, Artificial sequence
  Synthetic oligonucleotide
ggcttcaacggcctggacagcaaga

SEQ ID NO: 722562 - DNA, 25 bp, Artificial sequence
  Synthetic oligonucleotide
ctcggcggcttcaacggcctggaca

SEQ ID NO: 722563 - DNA, 25 bp, Artificial sequence
  Synthetic oligonucleotide
agcctgctcggcggcttcaacggcc

SEQ ID NO: 722564 - DNA, 25 bp, Artificial sequence
  Synthetic oligonucleotide
ttcatcagcctgctcggcggcttca

SEQ ID NO: 722565 - DNA, 25 bp, Artificial sequence
  Synthetic oligonucleotide
gtcagcttcatcagcctgctcggcg

SEQ ID NO: 722566 - DNA, 25 bp, Artificial sequence
  Synthetic oligonucleotide
gagccggtcagcttcatcagcctgc

SEQ ID NO: 722567 - DNA, 25 bp, Artificial sequence
  Synthetic oligonucleotide
aagggcgagccggtcagcttcatca

SEQ ID NO: 722568 - DNA, 25 bp, Artificial sequence
  Synthetic oligonucleotide
cgtctcggccctcagcgtcgacccg

SEQ ID NO: 722569 - DNA, 25 bp, Artificial sequence
  Synthetic oligonucleotide
gagctggacgagaagggcgagccgg

SEQ ID NO: 722570 - DNA, 25 bp, Artificial sequence
  Synthetic oligonucleotide
gcaagatcccgcgcgccgaaggggt

SEQ ID NO: 722571 - DNA, 25 bp, Artificial sequence
  Synthetic oligonucleotide
catctgctgctggagctggacgaga

SEQ ID NO: 722572 - DNA, 25 bp, Artificial sequence
  Synthetic oligonucleotide
cgaatcgcatctgctgctggagctg

SEQ ID NO: 722573 - DNA, 25 bp, Artificial sequence
  Synthetic oligonucleotide
tcggccgaatcgcatctgctgctgg

SEQ ID NO: 722574 - DNA, 25 bp, Artificial sequence
  Synthetic oligonucleotide
gtgctgtcggccgaatcgcatctgc

SEQ ID NO: 722575 - DNA, 25 bp, Artificial sequence
  Synthetic oligonucleotide
taccctggtgctgtcggccgaatcg

SEQ ID NO: 722576 - DNA, 25 bp, Artificial sequence
  Synthetic oligonucleotide
cggccataccctggtgctgtcggcc

SEQ ID NO: 722577 - DNA, 25 bp, Artificial sequence
  Synthetic oligonucleotide
cgacccgcgtaccggccataccctg

SEQ ID NO: 722578 - DNA, 25 bp, Artificial sequence
  Synthetic oligonucleotide
ataccctgaccatcttccatgtcga

SEQ ID NO: 722579 - DNA, 25 bp, Artificial sequence
  Synthetic oligonucleotide
gacgagaagggcgagccggtcagct

SEQ ID NO: 722580 - DNA, 25 bp, Artificial sequence
  Synthetic oligonucleotide
tacatggtcagcgagccgaacctgt

SEQ ID NO: 722581 - DNA, 25 bp, Artificial sequence
  Synthetic oligonucleotide
gacgagttcttcgccaagtgcgcga

SEQ ID NO: 722582 - DNA, 25 bp, Artificial sequence
  Synthetic oligonucleotide
cgcctggccaccagcgacgccgatt

SEQ ID NO: 722583 - DNA, 25 bp, Artificial sequence
  Synthetic oligonucleotide
cggcgagcgcctggccaccagcgac

SEQ ID NO: 722584 - DNA, 25 bp, Artificial sequence
  Synthetic oligonucleotide
aagagcggcgagcgcctggccacca

SEQ ID NO: 722585 - DNA, 25 bp, Artificial sequence
  Synthetic oligonucleotide
cgcaagaagagcggcgagcgcctgg

SEQ ID NO: 722586 - DNA, 25 bp, Artificial sequence
  Synthetic oligonucleotide
gtgttccgcaagaagagcggcgagc

SEQ ID NO: 722587 - DNA, 25 bp, Artificial sequence
  Synthetic oligonucleotide
ttctacgtgttccgcaagaagagcg

SEQ ID NO: 722588 - DNA, 25 bp, Artificial sequence
  Synthetic oligonucleotide
aacctgttctacgtgttccgcaaga

SEQ ID NO: 722589 - DNA, 25 bp, Artificial sequence
  Synthetic oligonucleotide
aacggcctggacagcaagatcccgc

SEQ ID NO: 722590 - DNA, 25 bp, Artificial sequence
  Synthetic oligonucleotide
gtcagcgagccgaacctgttctacg

SEQ ID NO: 722591 - DNA, 25 bp, Artificial sequence
  Synthetic oligonucleotide
tggacagcaagatcccgcgcgccga

SEQ ID NO: 722592 - DNA, 25 bp, Artificial sequence
  Synthetic oligonucleotide
accatctacatggtcagcgagccga

SEQ ID NO: 722593 - DNA, 25 bp, Artificial sequence
  Synthetic oligonucleotide
gagggcaccatctacatggtcagcg

SEQ ID NO: 722594 - DNA, 25 bp, Artificial sequence
  Synthetic oligonucleotide
gacgacgagggcaccatctacatgg

SEQ ID NO: 722595 - DNA, 25 bp, Artificial sequence
  Synthetic oligonucleotide
ggccatcgacgacgagggcaccatc

SEQ ID NO: 722596 - DNA, 25 bp, Artificial sequence
  Synthetic oligonucleotide
aggggtggccatcgacgacgagggc

SEQ ID NO: 722597 - DNA, 25 bp, Artificial sequence
  Synthetic oligonucleotide
gcgccgaaggggtggccatcgacga

SEQ ID NO: 722598 - DNA, 25 bp, Artificial sequence
  Synthetic oligonucleotide
tcccgcgcgccgaaggggtggccat

SEQ ID NO: 722599 - DNA, 25 bp, Artificial sequence
  Synthetic oligonucleotide
cgcaacgtctcggccctcagcgtcg

SEQ ID NO: 722600 - DNA, 25 bp, Artificial sequence
  Synthetic oligonucleotide
gagccgaacctgttctacgtgttcc

SEQ ID NO: 722601 - DNA, 25 bp, Artificial sequence
  Synthetic oligonucleotide
cgaattcccgctgggcaatattggc

SEQ ID NO: 722602 - DNA, 25 bp, Artificial sequence
  Synthetic oligonucleotide
gggatccgcgccagcagcgtctgtt

SEQ ID NO: 722603 - DNA, 25 bp, Artificial sequence
  Synthetic oligonucleotide
atcgcctgggatccgcgccagcagc

SEQ ID NO: 722604 - DNA, 25 bp, Artificial sequence
  Synthetic oligonucleotide
gagggcatcgcctgggatccgcgcc

SEQ ID NO: 722605 - DNA, 25 bp, Artificial sequence
  Synthetic oligonucleotide
ggcttcgagggcatcgcctgggatc

SEQ ID NO: 722606 - DNA, 25 bp, Artificial sequence
  Synthetic oligonucleotide
aacaagggcttcgagggcatcgcct

SEQ ID NO: 722607 - DNA, 25 bp, Artificial sequence
  Synthetic oligonucleotide
caagaagaacaagggcttcgagggc

SEQ ID NO: 722608 - DNA, 25 bp, Artificial sequence
  Synthetic oligonucleotide
tattggcaagaagaacaagggcttc

SEQ ID NO: 722609 - DNA, 25 bp, Artificial sequence
  Synthetic oligonucleotide
ggccctcagcgtcgacccgcgtacc

SEQ ID NO: 722610 - DNA, 25 bp, Artificial sequence
  Synthetic oligonucleotide
cccgctgggcaatattggcaagaag

SEQ ID NO: 722611 - DNA, 25 bp, Artificial sequence
  Synthetic oligonucleotide
gtctgttgctgagcaaggagcgcga

SEQ ID NO: 722612 - DNA, 25 bp, Artificial sequence
  Synthetic oligonucleotide
cctggccgaattcccgctgggcaat

SEQ ID NO: 722613 - DNA, 25 bp, Artificial sequence
  Synthetic oligonucleotide
caagagcctggccgaattcccgctg

SEQ ID NO: 722614 - DNA, 25 bp, Artificial sequence
  Synthetic oligonucleotide
tgagcaccaagagcctggccgaatt

SEQ ID NO: 722615 - DNA, 25 bp, Artificial sequence
  Synthetic oligonucleotide
ccgagctgagcaccaagagcctggc

SEQ ID NO: 722616 - DNA, 25 bp, Artificial sequence
  Synthetic oligonucleotide
agaccgccgagctgagcaccaagag

SEQ ID NO: 722617 - DNA, 25 bp, Artificial sequence
  Synthetic oligonucleotide
acccgcagaccgccgagctgagcac

SEQ ID NO: 722618 - DNA, 25 bp, Artificial sequence
  Synthetic oligonucleotide
atgtcgacccgcagaccgccgagct

SEQ ID NO: 722619 - DNA, 25 bp, Artificial sequence
  Synthetic oligonucleotide
agcgtcgacccgcgtaccggccata

SEQ ID NO: 722620 - DNA, 25 bp, Artificial sequence
  Synthetic oligonucleotide
gggcaatattggcaagaagaacaag

SEQ ID NO: 722621 - DNA, 25 bp, Artificial sequence
  Synthetic oligonucleotide
agagcgacggcgggccgagcctgag

SEQ ID NO: 722622 - DNA, 25 bp, Artificial sequence
  Synthetic oligonucleotide
tacatgcgcaacgtctcggccctca

SEQ ID NO: 722623 - DNA, 25 bp, Artificial sequence
  Synthetic oligonucleotide
gacctgtacatgcgcaacgtctcgg

SEQ ID NO: 722624 - DNA, 25 bp, Artificial sequence
  Synthetic oligonucleotide
gcgacgacctgtacatgcgcaacgt

SEQ ID NO: 722625 - DNA, 25 bp, Artificial sequence
  Synthetic oligonucleotide
taccgagcgacgacctgtacatgcg

SEQ ID NO: 722626 - DNA, 25 bp, Artificial sequence
  Synthetic oligonucleotide
ccgcgctaccgagcgacgacctgta

SEQ ID NO: 722627 - DNA, 25 bp, Artificial sequence
  Synthetic oligonucleotide
cgatgaccgcgctaccgagcgacga

SEQ ID NO: 722628 - DNA, 25 bp, Artificial sequence
  Synthetic oligonucleotide
gcggggcgatgaccgcgctaccgag

SEQ ID NO: 722629 - DNA, 25 bp, Artificial sequence
  Synthetic oligonucleotide
cctgagcggggcgatgaccgcgcta

SEQ ID NO: 722630 - DNA, 25 bp, Artificial sequence
  Synthetic oligonucleotide
gcgccagcagcgtctgttgctgagc

SEQ ID NO: 722631 - DNA, 25 bp, Artificial sequence
  Synthetic oligonucleotide
acggcgggccgagcctgagcggggc

SEQ ID NO: 722632 - DNA, 25 bp, Artificial sequence
  Synthetic oligonucleotide
agcagcgtctgttgctgagcaagga

SEQ ID NO: 722633 - DNA, 25 bp, Artificial sequence
  Synthetic oligonucleotide
gctggaagagcgacggcgggccgag

SEQ ID NO: 722634 - DNA, 25 bp, Artificial sequence
  Synthetic oligonucleotide
tgttcagctggaagagcgacggcgg

SEQ ID NO: 722635 - DNA, 25 bp, Artificial sequence
  Synthetic oligonucleotide
tgaccctgttcagctggaagagcga

SEQ ID NO: 722636 - DNA, 25 bp, Artificial sequence
  Synthetic oligonucleotide
atccgatgaccctgttcagctggaa

SEQ ID NO: 722637 - DNA, 25 bp, Artificial sequence
  Synthetic oligonucleotide
agcgcgatccgatgaccctgttcag

SEQ ID NO: 722638 - DNA, 25 bp, Artificial sequence
  Synthetic oligonucleotide
gcaaggagcgcgatccgatgaccct

SEQ ID NO: 722639 - DNA, 25 bp, Artificial sequence
  Synthetic oligonucleotide
tgctgagcaaggagcgcgatccgat

SEQ ID NO: 722640 - DNA, 25 bp, Artificial sequence
  Synthetic oligonucleotide
tgaccatcttccatgtcgacccgca

SEQ ID NO: 722641 - DNA, 25 bp, Artificial sequence
  Synthetic oligonucleotide
ggccgagcctgagcggggcgatgac

SEQ ID NO: 722642 - DNA, 25 bp, Artificial sequence
  Synthetic oligonucleotide
tcaatatatcgacggcaccccgatc

SEQ ID NO: 722643 - DNA, 25 bp, Artificial sequence
  Synthetic oligonucleotide
actacgaggcggaaatcgccgtgct

SEQ ID NO: 722644 - DNA, 25 bp, Artificial sequence
  Synthetic oligonucleotide
ctgcgtcgggcgcaactacgccgaa

SEQ ID NO: 722645 - DNA, 25 bp, Artificial sequence
  Synthetic oligonucleotide
agctggtctgcgtcgggcgcaacta

SEQ ID NO: 722646 - DNA, 25 bp, Artificial sequence
  Synthetic oligonucleotide
tgggcaagctggtctgcgtcgggcg

SEQ ID NO: 722647 - DNA, 25 bp, Artificial sequence
  Synthetic oligonucleotide
tccccctgggcaagctggtctgcgt

SEQ ID NO: 722648 - DNA, 25 bp, Artificial sequence
  Synthetic oligonucleotide
ccacttccccctgggcaagctggtc

SEQ ID NO: 722649 - DNA, 25 bp, Artificial sequence
  Synthetic oligonucleotide
cccgatccacttccccctgggcaag

SEQ ID NO: 722650 - DNA, 25 bp, Artificial sequence
  Synthetic oligonucleotide
caactacgccgaacacgccaaggaa

SEQ ID NO: 722651 - DNA, 25 bp, Artificial sequence
  Synthetic oligonucleotide
atatcgacggcaccccgatccactt

SEQ ID NO: 722652 - DNA, 25 bp, Artificial sequence
  Synthetic oligonucleotide
cgccgaacacgccaaggaactgaac

SEQ ID NO: 722653 - DNA, 25 bp, Artificial sequence
  Synthetic oligonucleotide
ccagcatcaatatatcgacggcacc

SEQ ID NO: 722654 - DNA, 25 bp, Artificial sequence
  Synthetic oligonucleotide
gagttaccagcatcaatatatcgac

SEQ ID NO: 722655 - DNA, 25 bp, Artificial sequence
  Synthetic oligonucleotide
gtaaatgagttaccagcatcaatat

SEQ ID NO: 722656 - DNA, 25 bp, Artificial sequence
  Synthetic oligonucleotide
gagtcggtaaatgagttaccagcat

SEQ ID NO: 722657 - DNA, 25 bp, Artificial sequence
  Synthetic oligonucleotide
gttcaggagtcggtaaatgagttac

SEQ ID NO: 722658 - DNA, 25 bp, Artificial sequence
  Synthetic oligonucleotide
ccacccgttcaggagtcggtaaatg

SEQ ID NO: 722659 - DNA, 25 bp, Artificial sequence
  Synthetic oligonucleotide
atgcctttccacccgttcaggagtc

SEQ ID NO: 722660 - DNA, 25 bp, Artificial sequence
  Synthetic oligonucleotide
gccacggatgcctttccacccgttc

SEQ ID NO: 722661 - DNA, 25 bp, Artificial sequence
  Synthetic oligonucleotide
cggcaccccgatccacttccccctg

SEQ ID NO: 722662 - DNA, 25 bp, Artificial sequence
  Synthetic oligonucleotide
ctcctgcgtggtgccggtgagcggc

SEQ ID NO: 722663 - DNA, 25 bp, Artificial sequence
  Synthetic oligonucleotide
cggtacactacgaggcggaaatcgc

SEQ ID NO: 722664 - DNA, 25 bp, Artificial sequence
  Synthetic oligonucleotide
gcggctcggtacactacgaggcgga

SEQ ID NO: 722665 - DNA, 25 bp, Artificial sequence
  Synthetic oligonucleotide
aggagcgcggctcggtacactacga

SEQ ID NO: 722666 - DNA, 25 bp, Artificial sequence
  Synthetic oligonucleotide
tgccgcaggagcgcggctcggtaca

SEQ ID NO: 722667 - DNA, 25 bp, Artificial sequence
  Synthetic oligonucleotide
tgagcctgccgcaggagcgcggctc

SEQ ID NO: 722668 - DNA, 25 bp, Artificial sequence
  Synthetic oligonucleotide
gcgggctgagcctgccgcaggagcg

SEQ ID NO: 722669 - DNA, 25 bp, Artificial sequence
  Synthetic oligonucleotide
tgagcggcgggctgagcctgccgca

SEQ ID NO: 722670 - DNA, 25 bp, Artificial sequence
  Synthetic oligonucleotide
cgggcgcaactacgccgaacacgcc

SEQ ID NO: 722671 - DNA, 25 bp, Artificial sequence
  Synthetic oligonucleotide
cgtggtgccggtgagcggcgggctg

SEQ ID NO: 722672 - DNA, 25 bp, Artificial sequence
  Synthetic oligonucleotide
cttctcgtctgtggcgggcgccacg

SEQ ID NO: 722673 - DNA, 25 bp, Artificial sequence
  Synthetic oligonucleotide
gcccggctcctgcgtggtgccggtg

SEQ ID NO: 722674 - DNA, 25 bp, Artificial sequence
  Synthetic oligonucleotide
catcaagcccggctcctgcgtggtg

SEQ ID NO: 722675 - DNA, 25 bp, Artificial sequence
  Synthetic oligonucleotide
tgctgttcatcaagcccggctcctg

SEQ ID NO: 722676 - DNA, 25 bp, Artificial sequence
  Synthetic oligonucleotide
agccgctgctgttcatcaagcccgg

SEQ ID NO: 722677 - DNA, 25 bp, Artificial sequence
  Synthetic oligonucleotide
caccgagccgctgctgttcatcaag

SEQ ID NO: 722678 - DNA, 25 bp, Artificial sequence
  Synthetic oligonucleotide
ggttcccaccgagccgctgctgttc

SEQ ID NO: 722679 - DNA, 25 bp, Artificial sequence
  Synthetic oligonucleotide
caacccggttcccaccgagccgctg

SEQ ID NO: 722680 - DNA, 25 bp, Artificial sequence
  Synthetic oligonucleotide
acacgccaaggaactgaacaacccg

SEQ ID NO: 722681 - DNA, 25 bp, Artificial sequence
  Synthetic oligonucleotide
tgccggtgagcggcgggctgagcct

SEQ ID NO: 722682 - DNA, 25 bp, Artificial sequence
  Synthetic oligonucleotide
gagaagtacaacggctcgatttccg

SEQ ID NO: 722683 - DNA, 25 bp, Artificial sequence
  Synthetic oligonucleotide
actacttgacctacacccgctcgga

SEQ ID NO: 722684 - DNA, 25 bp, Artificial sequence
  Synthetic oligonucleotide
agcgcgactacttgacctacacccg

SEQ ID NO: 722685 - DNA, 25 bp, Artificial sequence
  Synthetic oligonucleotide
tgaccaagcgcgactacttgaccta

SEQ ID NO: 722686 - DNA, 25 bp, Artificial sequence
  Synthetic oligonucleotide
tgggcatgaccaagcgcgactactt

SEQ ID NO: 722687 - DNA, 25 bp, Artificial sequence
  Synthetic oligonucleotide
atggcgtgggcatgaccaagcgcga

SEQ ID NO: 722688 - DNA, 25 bp, Artificial sequence
  Synthetic oligonucleotide
ccgagcatggcgtgggcatgaccaa

SEQ ID NO: 722689 - DNA, 25 bp, Artificial sequence
  Synthetic oligonucleotide
tttccgccgagcatggcgtgggcat

SEQ ID NO: 722690 - DNA, 25 bp, Artificial sequence
  Synthetic oligonucleotide
gcgggcgccacggatgcctttccac

SEQ ID NO: 722691 - DNA, 25 bp, Artificial sequence
  Synthetic oligonucleotide
tacaacggctcgatttccgccgagc

SEQ ID NO: 722692 - DNA, 25 bp, Artificial sequence
  Synthetic oligonucleotide
cgaaattgcctatatgaaggcactg

SEQ ID NO: 722693 - DNA, 25 bp, Artificial sequence
  Synthetic oligonucleotide
accgtcgagaagtacaacggctcga

SEQ ID NO: 722694 - DNA, 25 bp, Artificial sequence
  Synthetic oligonucleotide
ttcgagaccgtcgagaagtacaacg

SEQ ID NO: 722695 - DNA, 25 bp, Artificial sequence
  Synthetic oligonucleotide
tgggtgttcgagaccgtcgagaagt

SEQ ID NO: 722696 - DNA, 25 bp, Artificial sequence
  Synthetic oligonucleotide
aacaagtgggtgttcgagaccgtcg

SEQ ID NO: 722697 - DNA, 25 bp, Artificial sequence
  Synthetic oligonucleotide
accgtcaacaagtgggtgttcgaga

SEQ ID NO: 722698 - DNA, 25 bp, Artificial sequence
  Synthetic oligonucleotide
ctgtcggtcggctggccgacgcttc

SEQ ID NO: 722699 - DNA, 25 bp, Artificial sequence
  Synthetic oligonucleotide
gcgtaccggccataccctggtgctg

SEQ ID NO: 722700 - DNA, 25 bp, Artificial sequence
  Synthetic oligonucleotide
tgcgcgaccgtcaacaagtgggtgt

SEQ ID NO: 722701 - DNA, 25 bp, Artificial sequence
  Synthetic oligonucleotide
gctcgatttccgccgagcatggcgt

SEQ ID NO: 722702 - DNA, 25 bp, Artificial sequence
  Synthetic oligonucleotide
cccggcaagatcttcgccgagtagc

SEQ ID NO: 722703 - DNA, 25 bp, Artificial sequence
  Synthetic oligonucleotide
tgcctatatgaaggcactgaaggcg

SEQ ID NO: 722704 - DNA, 25 bp, Artificial sequence
  Synthetic oligonucleotide
ccggcccttctcgtctgtggcgggc

SEQ ID NO: 722705 - DNA, 25 bp, Artificial sequence
  Synthetic oligonucleotide
ggtcatccggcccttctcgtctgtg

SEQ ID NO: 722706 - DNA, 25 bp, Artificial sequence
  Synthetic oligonucleotide
agggccggtcatccggcccttctcg

SEQ ID NO: 722707 - DNA, 25 bp, Artificial sequence
  Synthetic oligonucleotide
acgcagagggccggtcatccggccc

SEQ ID NO: 722708 - DNA, 25 bp, Artificial sequence
  Synthetic oligonucleotide
gtcgcaacgcagagggccggtcatc

SEQ ID NO: 722709 - DNA, 25 bp, Artificial sequence
  Synthetic oligonucleotide
gcaggtgtcgcaacgcagagggccg

SEQ ID NO: 722710 - DNA, 25 bp, Artificial sequence
  Synthetic oligonucleotide
cgagtagcaggtgtcgcaacgcaga

SEQ ID NO: 722711 - DNA, 25 bp, Artificial sequence
  Synthetic oligonucleotide
tgacctacacccgctcggaaaccga

SEQ ID NO: 722712 - DNA, 25 bp, Artificial sequence
  Synthetic oligonucleotide
aagatcttcgccgagtagcaggtgt

SEQ ID NO: 722713 - DNA, 25 bp, Artificial sequence
  Synthetic oligonucleotide
ccgctcggaaaccgaaattgcctat

SEQ ID NO: 722714 - DNA, 25 bp, Artificial sequence
  Synthetic oligonucleotide
atgaatcccggcaagatcttcgccg

SEQ ID NO: 722715 - DNA, 25 bp, Artificial sequence
  Synthetic oligonucleotide
gggatcatgaatcccggcaagatct

SEQ ID NO: 722716 - DNA, 25 bp, Artificial sequence
  Synthetic oligonucleotide
cccaacgggatcatgaatcccggca

SEQ ID NO: 722717 - DNA, 25 bp, Artificial sequence
  Synthetic oligonucleotide
ttcgaccccaacgggatcatgaatc

SEQ ID NO: 722718 - DNA, 25 bp, Artificial sequence
  Synthetic oligonucleotide
gcggtgttcgaccccaacgggatca

SEQ ID NO: 722719 - DNA, 25 bp, Artificial sequence
  Synthetic oligonucleotide
ggcactgaaggcggtgttcgacccc

SEQ ID NO: 722720 - DNA, 25 bp, Artificial sequence
  Synthetic oligonucleotide
tatgaaggcactgaaggcggtgttc

SEQ ID NO: 722721 - DNA, 25 bp, Artificial sequence
  Synthetic oligonucleotide
tctgtggcgggcgccacggatgcct

SEQ ID NO: 722722 - DNA, 25 bp, Artificial sequence
  Synthetic oligonucleotide
ttcgccgagtagcaggtgtcgcaac

SEQ ID NO: 722723 - DNA, 25 bp, Artificial sequence
  Synthetic oligonucleotide
tcgccgggcatttctcgctacaggc

SEQ ID NO: 722724 - DNA, 25 bp, Artificial sequence
  Synthetic oligonucleotide
ggtcgggccgctgaacagcggcgac

SEQ ID NO: 722725 - DNA, 25 bp, Artificial sequence
  Synthetic oligonucleotide
gtccggggtcgggccgctgaacagc

SEQ ID NO: 722726 - DNA, 25 bp, Artificial sequence
  Synthetic oligonucleotide
cacgccgtccggggtcgggccgctg

SEQ ID NO: 722727 - DNA, 25 bp, Artificial sequence
  Synthetic oligonucleotide
ggtgctgaccggcacgccgtccggg

SEQ ID NO: 722728 - DNA, 25 bp, Artificial sequence
  Synthetic oligonucleotide
gatgtggtgctgaccggcacgccgt

SEQ ID NO: 722729 - DNA, 25 bp, Artificial sequence
  Synthetic oligonucleotide
gccggcgatgtggtgctgaccggca

SEQ ID NO: 722730 - DNA, 25 bp, Artificial sequence
  Synthetic oligonucleotide
ctacaggccggcgatgtggtgctga

SEQ ID NO: 722731 - DNA, 25 bp, Artificial sequence
  Synthetic oligonucleotide
gccaggacggcaacagccgcgacat

SEQ ID NO: 722732 - DNA, 25 bp, Artificial sequence
  Synthetic oligonucleotide
ggcatttctcgctacaggccggcga

SEQ ID NO: 722733 - DNA, 25 bp, Artificial sequence
  Synthetic oligonucleotide
gcgacgagttgctgctcgaattgcc

SEQ ID NO: 722734 - DNA, 25 bp, Artificial sequence
  Synthetic oligonucleotide
agcacatcgccgggcatttctcgct

SEQ ID NO: 722735 - DNA, 25 bp, Artificial sequence
  Synthetic oligonucleotide
tgatccagcacatcgccgggcattt

SEQ ID NO: 722736 - DNA, 25 bp, Artificial sequence
  Synthetic oligonucleotide
tgccgctgatccagcacatcgccgg

SEQ ID NO: 722737 - DNA, 25 bp, Artificial sequence
  Synthetic oligonucleotide
cgatcgtgccgctgatccagcacat

SEQ ID NO: 722738 - DNA, 25 bp, Artificial sequence
  Synthetic oligonucleotide
tcaatccgatcgtgccgctgatcca

SEQ ID NO: 722739 - DNA, 25 bp, Artificial sequence
  Synthetic oligonucleotide
gacatgctcaatccgatcgtgccgc

SEQ ID NO: 722740 - DNA, 25 bp, Artificial sequence
  Synthetic oligonucleotide
agccgcgacatgctcaatccgatcg

SEQ ID NO: 722741 - DNA, 25 bp, Artificial sequence
  Synthetic oligonucleotide
cggcaacagccgcgacatgctcaat

SEQ ID NO: 722742 - DNA, 25 bp, Artificial sequence
  Synthetic oligonucleotide
ttctcgctacaggccggcgatgtgg

SEQ ID NO: 722743 - DNA, 25 bp, Artificial sequence
  Synthetic oligonucleotide
aaccgctgcggccgccgggtgcggc

SEQ ID NO: 722744 - DNA, 25 bp, Artificial sequence
  Synthetic oligonucleotide
gcagcggaaacgactgtcggtcggc

SEQ ID NO: 722745 - DNA, 25 bp, Artificial sequence
  Synthetic oligonucleotide
gcgccggcagcggaaacgactgtcg

SEQ ID NO: 722746 - DNA, 25 bp, Artificial sequence
  Synthetic oligonucleotide
aaacgactgtcggtcggctggccga

SEQ ID NO: 722747 - DNA, 25 bp, Artificial sequence
  Synthetic oligonucleotide
ggaaaccgaaattgcctatatgaag

SEQ ID NO: 722748 - DNA, 25 bp, Artificial sequence
  Synthetic oligonucleotide
aggcggaaatcgccgtgctgatcgg

SEQ ID NO: 722749 - DNA, 25 bp, Artificial sequence
  Synthetic oligonucleotide
tccctagcgccggcagcggaaacga

SEQ ID NO: 722750 - DNA, 25 bp, Artificial sequence
  Synthetic oligonucleotide
ccggcctccctagcgccggcagcgg

SEQ ID NO: 722751 - DNA, 25 bp, Artificial sequence
  Synthetic oligonucleotide
gtgcggccggcctccctagcgccgg

SEQ ID NO: 722752 - DNA, 25 bp, Artificial sequence
  Synthetic oligonucleotide
ccgctgaacagcggcgacgagttgc

SEQ ID NO: 722753 - DNA, 25 bp, Artificial sequence
  Synthetic oligonucleotide
tgcggccgccgggtgcggccggcct

SEQ ID NO: 722754 - DNA, 25 bp, Artificial sequence
  Synthetic oligonucleotide
aacagcggcgacgagttgctgctcg

SEQ ID NO: 722755 - DNA, 25 bp, Artificial sequence
  Synthetic oligonucleotide
ctctgaaccgctgcggccgccgggt

SEQ ID NO: 722756 - DNA, 25 bp, Artificial sequence
  Synthetic oligonucleotide
cgcgtgctctgaaccgctgcggccg

SEQ ID NO: 722757 - DNA, 25 bp, Artificial sequence
  Synthetic oligonucleotide
cgtttcgagacccgcgtgctctgaa

SEQ ID NO: 722758 - DNA, 25 bp, Artificial sequence
  Synthetic oligonucleotide
cgggcgccagccgtttcgagacccg

SEQ ID NO: 722759 - DNA, 25 bp, Artificial sequence
  Synthetic oligonucleotide
aattgccgggcgccagccgtttcga

SEQ ID NO: 722760 - DNA, 25 bp, Artificial sequence
  Synthetic oligonucleotide
tgctcgaattgccgggcgccagccg

SEQ ID NO: 722761 - DNA, 25 bp, Artificial sequence
  Synthetic oligonucleotide
agttgctgctcgaattgccgggcgc

SEQ ID NO: 722762 - DNA, 25 bp, Artificial sequence
  Synthetic oligonucleotide
ccagccgtttcgagacccgcgtgct

SEQ ID NO: 722763 - DNA, 25 bp, Artificial sequence
  Synthetic oligonucleotide
cgccgggtgcggccggcctccctag

SEQ ID NO: 722764 - DNA, 25 bp, Artificial sequence
  Synthetic oligonucleotide
accgcgaggaggtcctcgacgcgat

SEQ ID NO: 722765 - DNA, 25 bp, Artificial sequence
  Synthetic oligonucleotide
actgaaggaaaagggcctgccctgg

SEQ ID NO: 722766 - DNA, 25 bp, Artificial sequence
  Synthetic oligonucleotide
gcgaaactgaaggaaaagggcctgc

SEQ ID NO: 722767 - DNA, 25 bp, Artificial sequence
  Synthetic oligonucleotide
cgcgaggtccaggcgaaactgaagg

SEQ ID NO: 722768 - DNA, 25 bp, Artificial sequence
  Synthetic oligonucleotide
accttgcgcgaggtccaggcgaaac

SEQ ID NO: 722769 - DNA, 25 bp, Artificial sequence
  Synthetic oligonucleotide
gacctgaccttgcgcgaggtccagg

SEQ ID NO: 722770 - DNA, 25 bp, Artificial sequence
  Synthetic oligonucleotide
gcgctggacctgaccttgcgcgagg

SEQ ID NO: 722771 - DNA, 25 bp, Artificial sequence
  Synthetic oligonucleotide
gcgccggcgctggacctgaccttgc

SEQ ID NO: 722772 - DNA, 25 bp, Artificial sequence
  Synthetic oligonucleotide
ggctatgcgccggcgctggacctga

SEQ ID NO: 722773 - DNA, 25 bp, Artificial sequence
  Synthetic oligonucleotide
ggaaaagggcctgccctgggagctg

SEQ ID NO: 722774 - DNA, 25 bp, Artificial sequence
  Synthetic oligonucleotide
aggaggtcctcgacgcgatctccgg

SEQ ID NO: 722775 - DNA, 25 bp, Artificial sequence
  Synthetic oligonucleotide
gatctccggctatgcgccggcgctg

SEQ ID NO: 722776 - DNA, 25 bp, Artificial sequence
  Synthetic oligonucleotide
agccgaaccgcgaggaggtcctcga

SEQ ID NO: 722777 - DNA, 25 bp, Artificial sequence
  Synthetic oligonucleotide
cgcgcaagccgaaccgcgaggaggt

SEQ ID NO: 722778 - DNA, 25 bp, Artificial sequence
  Synthetic oligonucleotide
aggtgcgccaggacggcaacagccg

SEQ ID NO: 722779 - DNA, 25 bp, Artificial sequence
  Synthetic oligonucleotide
aaatcgccgtgctgatcggcaagcc

SEQ ID NO: 722780 - DNA, 25 bp, Artificial sequence
  Synthetic oligonucleotide
gagacccgcgtgctctgaaccgctg

SEQ ID NO: 722781 - DNA, 25 bp, Artificial sequence
  Synthetic oligonucleotide
cgtgctgatcggcaagccgctgtcg

SEQ ID NO: 722782 - DNA, 25 bp, Artificial sequence
  Synthetic oligonucleotide
gatcggcaagccgctgtcgcgcaag

SEQ ID NO: 722783 - DNA, 25 bp, Artificial sequence
  Synthetic oligonucleotide
cgctgtcgcgcaagccgaaccgcga

SEQ ID NO: 722784 - DNA, 25 bp, Artificial sequence
  Synthetic oligonucleotide
gcaagccgctgtcgcgcaagccgaa

SEQ ID NO: 722785 - DNA, 25 bp, Artificial sequence
  Synthetic oligonucleotide
gacgcgatctccggctatgcgccgg

SEQ ID NO: 722786 - DNA, 25 bp, Artificial sequence
  Synthetic oligonucleotide
tcgtgaacgccgaccagtttcccga

SEQ ID NO: 722787 - DNA, 25 bp, Artificial sequence
  Synthetic oligonucleotide
gcctgaccatcaacggcgaggtgcg

SEQ ID NO: 722788 - DNA, 25 bp, Artificial sequence
  Synthetic oligonucleotide
gcatccgcctgaccatcaacggcga

SEQ ID NO: 722789 - DNA, 25 bp, Artificial sequence
  Synthetic oligonucleotide
acatcggcatccgcctgaccatcaa

SEQ ID NO: 722790 - DNA, 25 bp, Artificial sequence
  Synthetic oligonucleotide
gtcctcgacgcgatctccggctatg

SEQ ID NO: 722791 - DNA, 25 bp, Artificial sequence
  Synthetic oligonucleotide
ccatcaacggcgaggtgcgccagga

SEQ ID NO: 722792 - DNA, 25 bp, Artificial sequence
  Synthetic oligonucleotide
acggcgaggtgcgccaggacggcaa

SEQ ID NO: 722793 - DNA, 25 bp, Artificial sequence
  Synthetic oligonucleotide
cgaccgacatcggcatccgcctgac

SEQ ID NO: 722794 - DNA, 25 bp, Artificial sequence
  Synthetic oligonucleotide
cagtttcccgacccgaccgacatcg

SEQ ID NO: 722795 - DNA, 25 bp, Artificial sequence
  Synthetic oligonucleotide
tgtcgccgttcgtgaacgccgacca

SEQ ID NO: 722796 - DNA, 25 bp, Artificial sequence
  Synthetic oligonucleotide
ggcgtgctgtcgccgttcgtgaacg

SEQ ID NO: 722797 - DNA, 25 bp, Artificial sequence
  Synthetic oligonucleotide
tggcaaagagcttcgatggcgccgg

SEQ ID NO: 722798 - DNA, 25 bp, Artificial sequence
  Synthetic oligonucleotide
ggcgccggcgtgctgtcgccgttcg

SEQ ID NO: 722799 - DNA, 25 bp, Artificial sequence
  Synthetic oligonucleotide
agggcctgccctgggagctggcaaa

SEQ ID NO: 722800 - DNA, 25 bp, Artificial sequence
  Synthetic oligonucleotide
tgccctgggagctggcaaagagctt

SEQ ID NO: 722801 - DNA, 25 bp, Artificial sequence
  Synthetic oligonucleotide
ttcgatggcgccggcgtgctgtcgc

SEQ ID NO: 722802 - DNA, 25 bp, Artificial sequence
  Synthetic oligonucleotide
agagcttcgatggcgccggcgtgct

SEQ ID NO: 722803 - DNA, 25 bp, Artificial sequence
  Synthetic oligonucleotide
gggagctggcaaagagcttcgatgg

SEQ ID NO: 722804 - DNA, 25 bp, Artificial sequence
  Synthetic oligonucleotide
ccgacccgaccgacatcggcatccg

SEQ ID NO: 722805 - DNA, 25 bp, Artificial sequence
  Synthetic oligonucleotide
aggcgatcctcctcgtgttcctggt

SEQ ID NO: 722806 - DNA, 25 bp, Artificial sequence
  Synthetic oligonucleotide
cacgctgatcccgaccatcgccgta

SEQ ID NO: 722807 - DNA, 25 bp, Artificial sequence
  Synthetic oligonucleotide
ccgcgccacgctgatcccgaccatc

SEQ ID NO: 722808 - DNA, 25 bp, Artificial sequence
  Synthetic oligonucleotide
gaacttccgcgccacgctgatcccg

SEQ ID NO: 722809 - DNA, 25 bp, Artificial sequence
  Synthetic oligonucleotide
cctgcagaacttccgcgccacgctg

SEQ ID NO: 722810 - DNA, 25 bp, Artificial sequence
  Synthetic oligonucleotide
cctgttcctgcagaacttccgcgcc

SEQ ID NO: 722811 - DNA, 25 bp, Artificial sequence
  Synthetic oligonucleotide
tcgtgttcctggtgatgtacctgtt

SEQ ID NO: 722812 - DNA, 25 bp, Artificial sequence
  Synthetic oligonucleotide
gatcccgaccatcgccgtaccggtg

SEQ ID NO: 722813 - DNA, 25 bp, Artificial sequence
  Synthetic oligonucleotide
tcctcctcgtgttcctggtgatgta

SEQ ID NO: 722814 - DNA, 25 bp, Artificial sequence
  Synthetic oligonucleotide
ggaccttcggcgtgctcgccgcgtt

SEQ ID NO: 722815 - DNA, 25 bp, Artificial sequence
  Synthetic oligonucleotide
gatgtacctgttcctgcagaacttc

SEQ ID NO: 722816 - DNA, 25 bp, Artificial sequence
  Synthetic oligonucleotide
cctggtgatgtacctgttcctgcag

SEQ ID NO: 722817 - DNA, 25 bp, Artificial sequence
  Synthetic oligonucleotide
atggtgctggccatcggcttgctgg

SEQ ID NO: 722818 - DNA, 25 bp, Artificial sequence
  Synthetic oligonucleotide
tgctcgccgcgttcggcttctcgat

SEQ ID NO: 722819 - DNA, 25 bp, Artificial sequence
  Synthetic oligonucleotide
accctgaccatgttcggcatggtgc

SEQ ID NO: 722820 - DNA, 25 bp, Artificial sequence
  Synthetic oligonucleotide
atcaacaccctgaccatgttcggca

SEQ ID NO: 722821 - DNA, 25 bp, Artificial sequence
  Synthetic oligonucleotide
ttctcgatcaacaccctgaccatgt

SEQ ID NO: 722822 - DNA, 25 bp, Artificial sequence
  Synthetic oligonucleotide
tggataccgccaaggcgatccgcca

SEQ ID NO: 722823 - DNA, 25 bp, Artificial sequence
  Synthetic oligonucleotide
tcggcgaggcgatcctcctcgtgtt

SEQ ID NO: 722824 - DNA, 25 bp, Artificial sequence
  Synthetic oligonucleotide
ggtgctgctggggaccttcggcgtg

SEQ ID NO: 722825 - DNA, 25 bp, Artificial sequence
  Synthetic oligonucleotide
gccgcgttcggcttctcgatcaaca

SEQ ID NO: 722826 - DNA, 25 bp, Artificial sequence
  Synthetic oligonucleotide
ttcggcatggtgctggccatcggct

SEQ ID NO: 722827 - DNA, 25 bp, Artificial sequence
  Synthetic oligonucleotide
tcggcgtgctcgccgcgttcggctt

SEQ ID NO: 722828 - DNA, 25 bp, Artificial sequence
  Synthetic oligonucleotide
accatgttcggcatggtgctggcca

SEQ ID NO: 722829 - DNA, 25 bp, Artificial sequence
  Synthetic oligonucleotide
gctggggaccttcggcgtgctcgcc

SEQ ID NO: 722830 - DNA, 25 bp, Artificial sequence
  Synthetic oligonucleotide
taccggtggtgctgctggggacctt

SEQ ID NO: 722831 - DNA, 25 bp, Artificial sequence
  Synthetic oligonucleotide
tcgccgtaccggtggtgctgctggg

SEQ ID NO: 722832 - DNA, 25 bp, Artificial sequence
  Synthetic oligonucleotide
gaccatcgccgtaccggtggtgctg

SEQ ID NO: 722833 - DNA, 25 bp, Artificial sequence
  Synthetic oligonucleotide
ttcggcttctcgatcaacaccctga

SEQ ID NO: 722834 - DNA, 25 bp, Artificial sequence
  Synthetic oligonucleotide
aacggcagcccggcgtccggtatcg

SEQ ID NO: 722835 - DNA, 25 bp, Artificial sequence
  Synthetic oligonucleotide
gcgccaacgcgctggataccgccaa

SEQ ID NO: 722836 - DNA, 25 bp, Artificial sequence
  Synthetic oligonucleotide
gccaccggcgccaacgcgctggata

SEQ ID NO: 722837 - DNA, 25 bp, Artificial sequence
  Synthetic oligonucleotide
aagctggccaccggcgccaacgcgc

SEQ ID NO: 722838 - DNA, 25 bp, Artificial sequence
  Synthetic oligonucleotide
gcgatcaagctggccaccggcgcca

SEQ ID NO: 722839 - DNA, 25 bp, Artificial sequence
  Synthetic oligonucleotide
ggtatcgcgatcaagctggccaccg

SEQ ID NO: 722840 - DNA, 25 bp, Artificial sequence
  Synthetic oligonucleotide
aggcgatccgccagaccatcgccaa

SEQ ID NO: 722841 - DNA, 25 bp, Artificial sequence
  Synthetic oligonucleotide
agcccggcgtccggtatcgcgatca

SEQ ID NO: 722842 - DNA, 25 bp, Artificial sequence
  Synthetic oligonucleotide
tccgccagaccatcgccaacctgga

SEQ ID NO: 722843 - DNA, 25 bp, Artificial sequence
  Synthetic oligonucleotide
ctggccatcggcttgctggtggacg

SEQ ID NO: 722844 - DNA, 25 bp, Artificial sequence
  Synthetic oligonucleotide
gtgatcgtggcgctgatcctcaccc

SEQ ID NO: 722845 - DNA, 25 bp, Artificial sequence
  Synthetic oligonucleotide
cagttcaacggcagcccggcgtccg

SEQ ID NO: 722846 - DNA, 25 bp, Artificial sequence
  Synthetic oligonucleotide
aacgcgcagttcaacggcagcccgg

SEQ ID NO: 722847 - DNA, 25 bp, Artificial sequence
  Synthetic oligonucleotide
gcatcaacgcgcagttcaacggcag

SEQ ID NO: 722848 - DNA, 25 bp, Artificial sequence
  Synthetic oligonucleotide
actacagcatcaacgcgcagttcaa

SEQ ID NO: 722849 - DNA, 25 bp, Artificial sequence
  Synthetic oligonucleotide
gcgtccggtatcgcgatcaagctgg

SEQ ID NO: 722850 - DNA, 25 bp, Artificial sequence
  Synthetic oligonucleotide
ccgcagggcatgaaggtggtctacc

SEQ ID NO: 722851 - DNA, 25 bp, Artificial sequence
  Synthetic oligonucleotide
tagtgaagaccctcggcgaggcgat

SEQ ID NO: 722852 - DNA, 25 bp, Artificial sequence
  Synthetic oligonucleotide
tgaggtagtgaagaccctcggcgag

SEQ ID NO: 722853 - DNA, 25 bp, Artificial sequence
  Synthetic oligonucleotide
gatccatgaggtagtgaagaccctc

SEQ ID NO: 722854 - DNA, 25 bp, Artificial sequence
  Synthetic oligonucleotide
ggcctcgatccatgaggtagtgaag

SEQ ID NO: 722855 - DNA, 25 bp, Artificial sequence
  Synthetic oligonucleotide
ggtctcggcctcgatccatgaggta

SEQ ID NO: 722856 - DNA, 25 bp, Artificial sequence
  Synthetic oligonucleotide
cccggtggtctcggcctcgatccat

SEQ ID NO: 722857 - DNA, 25 bp, Artificial sequence
  Synthetic oligonucleotide
acgcgctggataccgccaaggcgat

SEQ ID NO: 722858 - DNA, 25 bp, Artificial sequence
  Synthetic oligonucleotide
ggcatgaaggtggtctacccgtacg

SEQ ID NO: 722859 - DNA, 25 bp, Artificial sequence
  Synthetic oligonucleotide
ccgccaaggcgatccgccagaccat

SEQ ID NO: 722860 - DNA, 25 bp, Artificial sequence
  Synthetic oligonucleotide
ttcatgccgcagggcatgaaggtgg

SEQ ID NO: 722861 - DNA, 25 bp, Artificial sequence
  Synthetic oligonucleotide
aaccgttcatgccgcagggcatgaa

SEQ ID NO: 722862 - DNA, 25 bp, Artificial sequence
  Synthetic oligonucleotide
acctggaaccgttcatgccgcaggg

SEQ ID NO: 722863 - DNA, 25 bp, Artificial sequence
  Synthetic oligonucleotide
tcgccaacctggaaccgttcatgcc

SEQ ID NO: 722864 - DNA, 25 bp, Artificial sequence
  Synthetic oligonucleotide
agaccatcgccaacctggaaccgtt

SEQ ID NO: 722865 - DNA, 25 bp, Artificial sequence
  Synthetic oligonucleotide
agaccctcggcgaggcgatcctcct

SEQ ID NO: 722866 - DNA, 25 bp, Artificial sequence
  Synthetic oligonucleotide
caccaccccggtggtctcggcctcg

SEQ ID NO: 722867 - DNA, 25 bp, Artificial sequence
  Synthetic oligonucleotide
accatggcgagcacaagggcggctt

SEQ ID NO: 722868 - DNA, 25 bp, Artificial sequence
  Synthetic oligonucleotide
tctccatcaccatcgtgtcggccat

SEQ ID NO: 722869 - DNA, 25 bp, Artificial sequence
  Synthetic oligonucleotide
tcaccatcgtgtcggccatggccct

SEQ ID NO: 722870 - DNA, 25 bp, Artificial sequence
  Synthetic oligonucleotide
tcgtgtcggccatggccctctcggt

SEQ ID NO: 722871 - DNA, 25 bp, Artificial sequence
  Synthetic oligonucleotide
cggccatggccctctcggtgatcgt

SEQ ID NO: 722872 - DNA, 25 bp, Artificial sequence
  Synthetic oligonucleotide
tctcggtgatcgtggcgctgatcct

SEQ ID NO: 722873 - DNA, 25 bp, Artificial sequence
  Synthetic oligonucleotide
gtggcgctgatcctcaccccggcgc

SEQ ID NO: 722874 - DNA, 25 bp, Artificial sequence
  Synthetic oligonucleotide
ctgatcctcaccccggcgctctgcg

SEQ ID NO: 722875 - DNA, 25 bp, Artificial sequence
  Synthetic oligonucleotide
ctcaccccggcgctctgcgcgacca

SEQ ID NO: 722876 - DNA, 25 bp, Artificial sequence
  Synthetic oligonucleotide
ccggcgctctgcgcgaccatgctca

SEQ ID NO: 722877 - DNA, 25 bp, Artificial sequence
  Synthetic oligonucleotide
tctgcgcgaccatgctcaagccgat

SEQ ID NO: 722878 - DNA, 25 bp, Artificial sequence
  Synthetic oligonucleotide
cgaccatgctcaagccgatcgagaa

SEQ ID NO: 722879 - DNA, 25 bp, Artificial sequence
  Synthetic oligonucleotide
tgctcaagccgatcgagaaaggcga

SEQ ID NO: 722880 - DNA, 25 bp, Artificial sequence
  Synthetic oligonucleotide
agccgatcgagaaaggcgaccatgg

SEQ ID NO: 722881 - DNA, 25 bp, Artificial sequence
  Synthetic oligonucleotide
tggccctctcggtgatcgtggcgct

SEQ ID NO: 722882 - DNA, 25 bp, Artificial sequence
  Synthetic oligonucleotide
tcaaccggatgttcctttccaccac

SEQ ID NO: 722883 - DNA, 25 bp, Artificial sequence
  Synthetic oligonucleotide
ggctacgagcggggcgtggcgtcga

SEQ ID NO: 722884 - DNA, 25 bp, Artificial sequence
  Synthetic oligonucleotide
acccacggctacgagcggggcgtgg

SEQ ID NO: 722885 - DNA, 25 bp, Artificial sequence
  Synthetic oligonucleotide
cccgacatcgcccaggtccaggtgc

SEQ ID NO: 722886 - DNA, 25 bp, Artificial sequence
  Synthetic oligonucleotide
gccaggactacagcatcaacgcgca

SEQ ID NO: 722887 - DNA, 25 bp, Artificial sequence
  Synthetic oligonucleotide
tccaccacccacggctacgagcggg

SEQ ID NO: 722888 - DNA, 25 bp, Artificial sequence
  Synthetic oligonucleotide
tcgagaaaggcgaccatggcgagca

SEQ ID NO: 722889 - DNA, 25 bp, Artificial sequence
  Synthetic oligonucleotide
cggatgttcctttccaccacccacg

SEQ ID NO: 722890 - DNA, 25 bp, Artificial sequence
  Synthetic oligonucleotide
aaaggcgaccatggcgagcacaagg

SEQ ID NO: 722891 - DNA, 25 bp, Artificial sequence
  Synthetic oligonucleotide
gctggttcaaccggatgttcctttc

SEQ ID NO: 722892 - DNA, 25 bp, Artificial sequence
  Synthetic oligonucleotide
tcttcggctggttcaaccggatgtt

SEQ ID NO: 722893 - DNA, 25 bp, Artificial sequence
  Synthetic oligonucleotide
gcggcttcttcggctggttcaaccg

SEQ ID NO: 722894 - DNA, 25 bp, Artificial sequence
  Synthetic oligonucleotide
acaagggcggcttcttcggctggtt

SEQ ID NO: 722895 - DNA, 25 bp, Artificial sequence
  Synthetic oligonucleotide
gcgagcacaagggcggcttcttcgg

SEQ ID NO: 722896 - DNA, 25 bp, Artificial sequence
  Synthetic oligonucleotide
gggtgatctaccggcagttctccat

SEQ ID NO: 722897 - DNA, 25 bp, Artificial sequence
  Synthetic oligonucleotide
tcctttccaccacccacggctacga

SEQ ID NO: 722898 - DNA, 25 bp, Artificial sequence
  Synthetic oligonucleotide
cgtcgagcgggtgatggccgaggaa

SEQ ID NO: 722899 - DNA, 25 bp, Artificial sequence
  Synthetic oligonucleotide
ggcagttctccatcaccatcgtgtc

SEQ ID NO: 722900 - DNA, 25 bp, Artificial sequence
  Synthetic oligonucleotide
ggaggcggcgcgcaagtccatgggc

SEQ ID NO: 722901 - DNA, 25 bp, Artificial sequence
  Synthetic oligonucleotide
cgccaagggaggcggcgcgcaagtc

SEQ ID NO: 722902 - DNA, 25 bp, Artificial sequence
  Synthetic oligonucleotide
gcctgtcgccaagggaggcggcgcg

SEQ ID NO: 722903 - DNA, 25 bp, Artificial sequence
  Synthetic oligonucleotide
aggaaggcctgtcgccaagggaggc

SEQ ID NO: 722904 - DNA, 25 bp, Artificial sequence
  Synthetic oligonucleotide
aagtccatgggccagatccagggcg

SEQ ID NO: 722905 - DNA, 25 bp, Artificial sequence
  Synthetic oligonucleotide
cgggtgatggccgaggaaggcctgt

SEQ ID NO: 722906 - DNA, 25 bp, Artificial sequence
  Synthetic oligonucleotide
atgggccagatccagggcgcgctgg

SEQ ID NO: 722907 - DNA, 25 bp, Artificial sequence
  Synthetic oligonucleotide
ggagaacgtcgagcgggtgatggcc

SEQ ID NO: 722908 - DNA, 25 bp, Artificial sequence
  Synthetic oligonucleotide
gtggtggagaacgtcgagcgggtga

SEQ ID NO: 722909 - DNA, 25 bp, Artificial sequence
  Synthetic oligonucleotide
atcgtggtggtggagaacgtcgagc

SEQ ID NO: 722910 - DNA, 25 bp, Artificial sequence
  Synthetic oligonucleotide
gacgccatcgtggtggtggagaacg

SEQ ID NO: 722911 - DNA, 25 bp, Artificial sequence
  Synthetic oligonucleotide
gtggacgacgccatcgtggtggtgg

SEQ ID NO: 722912 - DNA, 25 bp, Artificial sequence
  Synthetic oligonucleotide
ttgctggtggacgacgccatcgtgg

SEQ ID NO: 722913 - DNA, 25 bp, Artificial sequence
  Synthetic oligonucleotide
atggccgaggaaggcctgtcgccaa

SEQ ID NO: 722914 - DNA, 25 bp, Artificial sequence
  Synthetic oligonucleotide
ctctcggcggtattcctgccgatgg

SEQ ID NO: 722915 - DNA, 25 bp, Artificial sequence
  Synthetic oligonucleotide
atcggcttgctggtggacgacgcca

SEQ ID NO: 722916 - DNA, 25 bp, Artificial sequence
  Synthetic oligonucleotide
ccaccggggtgatctaccggcagtt

SEQ ID NO: 722917 - DNA, 25 bp, Artificial sequence
  Synthetic oligonucleotide
gcggctccaccggggtgatctaccg

SEQ ID NO: 722918 - DNA, 25 bp, Artificial sequence
  Synthetic oligonucleotide
ttcttcggcggctccaccggggtga

SEQ ID NO: 722919 - DNA, 25 bp, Artificial sequence
  Synthetic oligonucleotide
ccgatggcgttcttcggcggctcca

SEQ ID NO: 722920 - DNA, 25 bp, Artificial sequence
  Synthetic oligonucleotide
ggcgcgcaagtccatgggccagatc

SEQ ID NO: 722921 - DNA, 25 bp, Artificial sequence
  Synthetic oligonucleotide
ggcggtattcctgccgatggcgttc

SEQ ID NO: 722922 - DNA, 25 bp, Artificial sequence
  Synthetic oligonucleotide
tctaccggcagttctccatcaccat

SEQ ID NO: 722923 - DNA, 25 bp, Artificial sequence
  Synthetic oligonucleotide
atggtgctctcggcggtattcctgc

SEQ ID NO: 722924 - DNA, 25 bp, Artificial sequence
  Synthetic oligonucleotide
tcgccatggtgctctcggcggtatt

SEQ ID NO: 722925 - DNA, 25 bp, Artificial sequence
  Synthetic oligonucleotide
tcggtatcgccatggtgctctcggc

SEQ ID NO: 722926 - DNA, 25 bp, Artificial sequence
  Synthetic oligonucleotide
cgctggtcggtatcgccatggtgct

SEQ ID NO: 722927 - DNA, 25 bp, Artificial sequence
  Synthetic oligonucleotide
agggcgcgctggtcggtatcgccat

SEQ ID NO: 722928 - DNA, 25 bp, Artificial sequence
  Synthetic oligonucleotide
agatccagggcgcgctggtcggtat

SEQ ID NO: 722929 - DNA, 25 bp, Artificial sequence
  Synthetic oligonucleotide
attcctgccgatggcgttcttcggc

SEQ ID NO: 722930 - DNA, 25 bp, Artificial sequence
  Synthetic oligonucleotide
cagaacaagctgcaactggccaccc

SEQ ID NO: 722931 - DNA, 25 bp, Artificial sequence
  Synthetic oligonucleotide
tcgacaatctgcgctacatctcctc

SEQ ID NO: 722932 - DNA, 25 bp, Artificial sequence
  Synthetic oligonucleotide
atctgcgctacatctcctcggagag

SEQ ID NO: 722933 - DNA, 25 bp, Artificial sequence
  Synthetic oligonucleotide
gctacatctcctcggagagtaactc

SEQ ID NO: 722934 - DNA, 25 bp, Artificial sequence
  Synthetic oligonucleotide
tctcctcggagagtaactccgacgg

SEQ ID NO: 722935 - DNA, 25 bp, Artificial sequence
  Synthetic oligonucleotide
cggagagtaactccgacggcagcat

SEQ ID NO: 722936 - DNA, 25 bp, Artificial sequence
  Synthetic oligonucleotide
gtaactccgacggcagcatgaccat

SEQ ID NO: 722937 - DNA, 25 bp, Artificial sequence
  Synthetic oligonucleotide
ccgacggcagcatgaccatcaccgt

SEQ ID NO: 722938 - DNA, 25 bp, Artificial sequence
  Synthetic oligonucleotide
tgaccatcaccgtgaccttcgaaca

SEQ ID NO: 722939 - DNA, 25 bp, Artificial sequence
  Synthetic oligonucleotide
tcaccgtgaccttcgaacagggcac

SEQ ID NO: 722940 - DNA, 25 bp, Artificial sequence
  Synthetic oligonucleotide
gtgaccttcgaacagggcaccgacc

SEQ ID NO: 722941 - DNA, 25 bp, Artificial sequence
  Synthetic oligonucleotide
ttcgaacagggcaccgaccccgaca

SEQ ID NO: 722942 - DNA, 25 bp, Artificial sequence
  Synthetic oligonucleotide
acagggcaccgaccccgacatcgcc

SEQ ID NO: 722943 - DNA, 25 bp, Artificial sequence
  Synthetic oligonucleotide
caccgaccccgacatcgcccaggtc

SEQ ID NO: 722944 - DNA, 25 bp, Artificial sequence
  Synthetic oligonucleotide
ctcatggtggtcggtgtggtttcca

SEQ ID NO: 722945 - DNA, 25 bp, Artificial sequence
  Synthetic oligonucleotide
aggaagtgcagcgccaggggatccg

SEQ ID NO: 722946 - DNA, 25 bp, Artificial sequence
  Synthetic oligonucleotide
caggtccaggtgcagaacaagctgc

SEQ ID NO: 722947 - DNA, 25 bp, Artificial sequence
  Synthetic oligonucleotide
gtgaagaacttcctcatggtggtcg

SEQ ID NO: 722948 - DNA, 25 bp, Artificial sequence
  Synthetic oligonucleotide
aaggcggtgaagaacttcctcatgg

SEQ ID NO: 722949 - DNA, 25 bp, Artificial sequence
  Synthetic oligonucleotide
ggtgaccaaggcggtgaagaacttc

SEQ ID NO: 722950 - DNA, 25 bp, Artificial sequence
  Synthetic oligonucleotide
ggatccgggtgaccaaggcggtgaa

SEQ ID NO: 722951 - DNA, 25 bp, Artificial sequence
  Synthetic oligonucleotide
atcgcccaggtccaggtgcagaaca

SEQ ID NO: 722952 - DNA, 25 bp, Artificial sequence
  Synthetic oligonucleotide
tgcagcgccaggggatccgggtgac

SEQ ID NO: 722953 - DNA, 25 bp, Artificial sequence
  Synthetic oligonucleotide
caggtgcagaacaagctgcaactgg

SEQ ID NO: 722954 - DNA, 25 bp, Artificial sequence
  Synthetic oligonucleotide
tgccgcaggaagtgcagcgccaggg

SEQ ID NO: 722955 - DNA, 25 bp, Artificial sequence
  Synthetic oligonucleotide
cgctactgccgcaggaagtgcagcg

SEQ ID NO: 722956 - DNA, 25 bp, Artificial sequence
  Synthetic oligonucleotide
ccaccccgctactgccgcaggaagt

SEQ ID NO: 722957 - DNA, 25 bp, Artificial sequence
  Synthetic oligonucleotide
aactggccaccccgctactgccgca

SEQ ID NO: 722958 - DNA, 25 bp, Artificial sequence
  Synthetic oligonucleotide
agctgcaactggccaccccgctact

SEQ ID NO: 722959 - DNA, 25 bp, Artificial sequence
  Synthetic oligonucleotide
agcagcagatgaacgggatcgacaa

SEQ ID NO: 722960 - DNA, 25 bp, Artificial sequence
  Synthetic oligonucleotide
gccaggggatccgggtgaccaaggc

SEQ ID NO: 722961 - DNA, 25 bp, Artificial sequence
  Synthetic oligonucleotide
tcatgctcgcgggcggcctgtcgat

SEQ ID NO: 722962 - DNA, 25 bp, Artificial sequence
  Synthetic oligonucleotide
acgggatcgacaatctgcgctacat

SEQ ID NO: 722963 - DNA, 25 bp, Artificial sequence
  Synthetic oligonucleotide
ccggtcaaccagtacccggccatcg

SEQ ID NO: 722964 - DNA, 25 bp, Artificial sequence
  Synthetic oligonucleotide
agtctgccggtcaaccagtacccgg

SEQ ID NO: 722965 - DNA, 25 bp, Artificial sequence
  Synthetic oligonucleotide
atcctcagtctgccggtcaaccagt

SEQ ID NO: 722966 - DNA, 25 bp, Artificial sequence
  Synthetic oligonucleotide
ctgtcgatcctcagtctgccggtca

SEQ ID NO: 722967 - DNA, 25 bp, Artificial sequence
  Synthetic oligonucleotide
tacccggccatcgccccgccggcca

SEQ ID NO: 722968 - DNA, 25 bp, Artificial sequence
  Synthetic oligonucleotide
tcgcgggcggcctgtcgatcctcag

SEQ ID NO: 722969 - DNA, 25 bp, Artificial sequence
  Synthetic oligonucleotide
gccatcgccccgccggccatcgccg

SEQ ID NO: 722970 - DNA, 25 bp, Artificial sequence
  Synthetic oligonucleotide
tggtgatcatgctcgcgggcggcct

SEQ ID NO: 722971 - DNA, 25 bp, Artificial sequence
  Synthetic oligonucleotide
tcgccttggtgatcatgctcgcggg

SEQ ID NO: 722972 - DNA, 25 bp, Artificial sequence
  Synthetic oligonucleotide
gggtgatcgccttggtgatcatgct

SEQ ID NO: 722973 - DNA, 25 bp, Artificial sequence
  Synthetic oligonucleotide
tcgcgtgggtgatcgccttggtgat

SEQ ID NO: 722974 - DNA, 25 bp, Artificial sequence
  Synthetic oligonucleotide
gagcggggcgtggcgtcgatcctca

SEQ ID NO: 722975 - DNA, 25 bp, Artificial sequence
  Synthetic oligonucleotide
acgaggagcgcttgtccggctcgca

SEQ ID NO: 722976 - DNA, 25 bp, Artificial sequence
  Synthetic oligonucleotide
ggcggcctgtcgatcctcagtctgc

SEQ ID NO: 722977 - DNA, 25 bp, Artificial sequence
  Synthetic oligonucleotide
gcctcggccgagacggtgcaggaca

SEQ ID NO: 722978 - DNA, 25 bp, Artificial sequence
  Synthetic oligonucleotide
gtcggtgtggtttccaccgacggca

SEQ ID NO: 722979 - DNA, 25 bp, Artificial sequence
  Synthetic oligonucleotide
tgatcgagcagcagatgaacgggat

SEQ ID NO: 722980 - DNA, 25 bp, Artificial sequence
  Synthetic oligonucleotide
gtccaggtgatcgagcagcagatga

SEQ ID NO: 722981 - DNA, 25 bp, Artificial sequence
  Synthetic oligonucleotide
accgtggtccaggtgatcgagcagc

SEQ ID NO: 722982 - DNA, 25 bp, Artificial sequence
  Synthetic oligonucleotide
caggacaccgtggtccaggtgatcg

SEQ ID NO: 722983 - DNA, 25 bp, Artificial sequence
  Synthetic oligonucleotide
caaccagtacccggccatcgccccg

SEQ ID NO: 722984 - DNA, 25 bp, Artificial sequence
  Synthetic oligonucleotide
gccgagacggtgcaggacaccgtgg

SEQ ID NO: 722985 - DNA, 25 bp, Artificial sequence
  Synthetic oligonucleotide
agatgaacgggatcgacaatctgcg

SEQ ID NO: 722986 - DNA, 25 bp, Artificial sequence
  Synthetic oligonucleotide
cccgggcgcctcggccgagacggtg

SEQ ID NO: 722987 - DNA, 25 bp, Artificial sequence
  Synthetic oligonucleotide
tgagctacccgggcgcctcggccga

SEQ ID NO: 722988 - DNA, 25 bp, Artificial sequence
  Synthetic oligonucleotide
tgcaggtgagctacccgggcgcctc

SEQ ID NO: 722989 - DNA, 25 bp, Artificial sequence
  Synthetic oligonucleotide
atcgccgtgcaggtgagctacccgg

SEQ ID NO: 722990 - DNA, 25 bp, Artificial sequence
  Synthetic oligonucleotide
cggccatcgccgtgcaggtgagcta

SEQ ID NO: 722991 - DNA, 25 bp, Artificial sequence
  Synthetic oligonucleotide
gccccgccggccatcgccgtgcagg

SEQ ID NO: 722992 - DNA, 25 bp, Artificial sequence
  Synthetic oligonucleotide
acggtgcaggacaccgtggtccagg

SEQ ID NO: 722993 - DNA, 25 bp, Artificial sequence
  Synthetic oligonucleotide
agaccgcggagcaattcgagaacat

SEQ ID NO: 722994 - DNA, 25 bp, Artificial sequence
  Synthetic oligonucleotide
agaacgtgcagatttcctccggcca

SEQ ID NO: 722995 - DNA, 25 bp, Artificial sequence
  Synthetic oligonucleotide
tgcagatttcctccggccagctcgg

SEQ ID NO: 722996 - DNA, 25 bp, Artificial sequence
  Synthetic oligonucleotide
tttcctccggccagctcggcggctt

SEQ ID NO: 722997 - DNA, 25 bp, Artificial sequence
  Synthetic oligonucleotide
ccggccagctcggcggcttgccggc

SEQ ID NO: 722998 - DNA, 25 bp, Artificial sequence
  Synthetic oligonucleotide
gctcggcggcttgccggcggtcaag

SEQ ID NO: 722999 - DNA, 25 bp, Artificial sequence
  Synthetic oligonucleotide
ggcttgccggcggtcaagggccagc

SEQ ID NO: 723000 - DNA, 25 bp, Artificial sequence
  Synthetic oligonucleotide
cggcggtcaagggccagcagctcaa

SEQ ID NO: 723001 - DNA, 25 bp, Artificial sequence
  Synthetic oligonucleotide
gtcaagggccagcagctcaacgcca

SEQ ID NO: 723002 - DNA, 25 bp, Artificial sequence
  Synthetic oligonucleotide
ggccagcagctcaacgccaccatca

SEQ ID NO: 723003 - DNA, 25 bp, Artificial sequence
  Synthetic oligonucleotide
cagctcaacgccaccatcatcggca

SEQ ID NO: 723004 - DNA, 25 bp, Artificial sequence
  Synthetic oligonucleotide
aacgccaccatcatcggcaagaccc

SEQ ID NO: 723005 - DNA, 25 bp, Artificial sequence
  Synthetic oligonucleotide
accatcatcggcaagacccgcctgc

SEQ ID NO: 723006 - DNA, 25 bp, Artificial sequence
  Synthetic oligonucleotide
atcggcaagacccgcctgcagaccg

SEQ ID NO: 723007 - DNA, 25 bp, Artificial sequence
  Synthetic oligonucleotide
aacttcctcatggtggtcggtgtgg

SEQ ID NO: 723008 - DNA, 25 bp, Artificial sequence
  Synthetic oligonucleotide
caatcccgacggttcccaggtgcgc

SEQ ID NO: 723009 - DNA, 25 bp, Artificial sequence
  Synthetic oligonucleotide
gtaggcctgggcggccaggactaca

SEQ ID NO: 723010 - DNA, 25 bp, Artificial sequence
  Synthetic oligonucleotide
gccgatgtaggcctgggcggccagg

SEQ ID NO: 723011 - DNA, 25 bp, Artificial sequence
  Synthetic oligonucleotide
ggacgtcgccgatgtaggcctgggc

SEQ ID NO: 723012 - DNA, 25 bp, Artificial sequence
  Synthetic oligonucleotide
ctgaaggacgtcgccgatgtaggcc

SEQ ID NO: 723013 - DNA, 25 bp, Artificial sequence
  Synthetic oligonucleotide
gtgcgcctgaaggacgtcgccgatg

SEQ ID NO: 723014 - DNA, 25 bp, Artificial sequence
  Synthetic oligonucleotide
aagacccgcctgcagaccgcggagc

SEQ ID NO: 723015 - DNA, 25 bp, Artificial sequence
  Synthetic oligonucleotide
cgacggttcccaggtgcgcctgaag

SEQ ID NO: 723016 - DNA, 25 bp, Artificial sequence
  Synthetic oligonucleotide
gcctgcagaccgcggagcaattcga

SEQ ID NO: 723017 - DNA, 25 bp, Artificial sequence
  Synthetic oligonucleotide
caaggtcaatcccgacggttcccag

SEQ ID NO: 723018 - DNA, 25 bp, Artificial sequence
  Synthetic oligonucleotide
cctgctcaaggtcaatcccgacggt

SEQ ID NO: 723019 - DNA, 25 bp, Artificial sequence
  Synthetic oligonucleotide
agaacatcctgctcaaggtcaatcc

SEQ ID NO: 723020 - DNA, 25 bp, Artificial sequence
  Synthetic oligonucleotide
aattcgagaacatcctgctcaaggt

SEQ ID NO: 723021 - DNA, 25 bp, Artificial sequence
  Synthetic oligonucleotide
cggagcaattcgagaacatcctgct

SEQ ID NO: 723022 - DNA, 25 bp, Artificial sequence
  Synthetic oligonucleotide
gcagcgcgatccaggcgcagaacgt

SEQ ID NO: 723023 - DNA, 25 bp, Artificial sequence
  Synthetic oligonucleotide
ttcccaggtgcgcctgaaggacgtc

SEQ ID NO: 723024 - DNA, 25 bp, Artificial sequence
  Synthetic oligonucleotide
tgtcgaactacatcgtttccaacat

SEQ ID NO: 723025 - DNA, 25 bp, Artificial sequence
  Synthetic oligonucleotide
aggcgcagaacgtgcagatttcctc

SEQ ID NO: 723026 - DNA, 25 bp, Artificial sequence
  Synthetic oligonucleotide
tctcgcggaccaagggcgtcggtga

SEQ ID NO: 723027 - DNA, 25 bp, Artificial sequence
  Synthetic oligonucleotide
acccactctcgcggaccaagggcgt

SEQ ID NO: 723028 - DNA, 25 bp, Artificial sequence
  Synthetic oligonucleotide
tccaggacccactctcgcggaccaa

SEQ ID NO: 723029 - DNA, 25 bp, Artificial sequence
  Synthetic oligonucleotide
ccaacatccaggacccactctcgcg

SEQ ID NO: 723030 - DNA, 25 bp, Artificial sequence
  Synthetic oligonucleotide
aagggcgtcggtgacttccaggtgt

SEQ ID NO: 723031 - DNA, 25 bp, Artificial sequence
  Synthetic oligonucleotide
actacatcgtttccaacatccagga

SEQ ID NO: 723032 - DNA, 25 bp, Artificial sequence
  Synthetic oligonucleotide
tcggtgacttccaggtgttcggctc

SEQ ID NO: 723033 - DNA, 25 bp, Artificial sequence
  Synthetic oligonucleotide
aagacctgtcgaactacatcgtttc

SEQ ID NO: 723034 - DNA, 25 bp, Artificial sequence
  Synthetic oligonucleotide
ccaaggaagacctgtcgaactacat

SEQ ID NO: 723035 - DNA, 25 bp, Artificial sequence
  Synthetic oligonucleotide
gcatgaccaaggaagacctgtcgaa

SEQ ID NO: 723036 - DNA, 25 bp, Artificial sequence
  Synthetic oligonucleotide
acggcagcatgaccaaggaagacct

SEQ ID NO: 723037 - DNA, 25 bp, Artificial sequence
  Synthetic oligonucleotide
tccaccgacggcagcatgaccaagg

SEQ ID NO: 723038 - DNA, 25 bp, Artificial sequence
  Synthetic oligonucleotide
gtggtttccaccgacggcagcatga

SEQ ID NO: 723039 - DNA, 25 bp, Artificial sequence
  Synthetic oligonucleotide
tcgtttccaacatccaggacccact

SEQ ID NO: 723040 - DNA, 25 bp, Artificial sequence
  Synthetic oligonucleotide
cggccaagctgaacagctaccagct

SEQ ID NO: 723041 - DNA, 25 bp, Artificial sequence
  Synthetic oligonucleotide
ctgggcggccaggactacagcatca

SEQ ID NO: 723042 - DNA, 25 bp, Artificial sequence
  Synthetic oligonucleotide
gacgtgagcagcgcgatccaggcgc

SEQ ID NO: 723043 - DNA, 25 bp, Artificial sequence
  Synthetic oligonucleotide
cccggcgacgtgagcagcgcgatcc

SEQ ID NO: 723044 - DNA, 25 bp, Artificial sequence
  Synthetic oligonucleotide
ctgacccccggcgacgtgagcagcg

SEQ ID NO: 723045 - DNA, 25 bp, Artificial sequence
  Synthetic oligonucleotide
taccagctgacccccggcgacgtga

SEQ ID NO: 723046 - DNA, 25 bp, Artificial sequence
  Synthetic oligonucleotide
ggaccaagggcgtcggtgacttcca

SEQ ID NO: 723047 - DNA, 25 bp, Artificial sequence
  Synthetic oligonucleotide
aagctgaacagctaccagctgaccc

SEQ ID NO: 723048 - DNA, 25 bp, Artificial sequence
  Synthetic oligonucleotide
cgatccaggcgcagaacgtgcagat

SEQ ID NO: 723049 - DNA, 25 bp, Artificial sequence
  Synthetic oligonucleotide
tcgacccggccaagctgaacagcta

SEQ ID NO: 723050 - DNA, 25 bp, Artificial sequence
  Synthetic oligonucleotide
atgcgcatctggctcgacccggcca

SEQ ID NO: 723051 - DNA, 25 bp, Artificial sequence
  Synthetic oligonucleotide
cgcagtactcgatgcgcatctggct

SEQ ID NO: 723052 - DNA, 25 bp, Artificial sequence
  Synthetic oligonucleotide
tcggctcgcagtactcgatgcgcat

SEQ ID NO: 723053 - DNA, 25 bp, Artificial sequence
  Synthetic oligonucleotide
aggtgttcggctcgcagtactcgat

SEQ ID NO: 723054 - DNA, 25 bp, Artificial sequence
  Synthetic oligonucleotide
acttccaggtgttcggctcgcagta

SEQ ID NO: 723055 - DNA, 25 bp, Artificial sequence
  Synthetic oligonucleotide
aacagctaccagctgacccccggcg

SEQ ID NO: 723056 - DNA, 25 bp, Artificial sequence
  Synthetic oligonucleotide
tctgcctggcggccctgtacgaaag

SEQ ID NO: 723057 - DNA, 25 bp, Artificial sequence
  Synthetic oligonucleotide
tactcctggaccggcctgtcctacg

SEQ ID NO: 723058 - DNA, 25 bp, Artificial sequence
  Synthetic oligonucleotide
tggaccggcctgtcctacgaggagc

SEQ ID NO: 723059 - DNA, 25 bp, Artificial sequence
  Synthetic oligonucleotide
ccattttcgcgtgggtgatcgcctt

SEQ ID NO: 723060 - DNA, 25 bp, Artificial sequence
  Synthetic oligonucleotide
gtcctacgaggagcgcttgtccggc

SEQ ID NO: 723061 - DNA, 25 bp, Artificial sequence
  Synthetic oligonucleotide
tactcgatgcgcatctggctcgacc

SEQ ID NO: 723062 - DNA, 25 bp, Artificial sequence
  Synthetic oligonucleotide
agcgcttgtccggctcgcaggcgcc

SEQ ID NO: 723063 - DNA, 25 bp, Artificial sequence
  Synthetic oligonucleotide
tgtccggctcgcaggcgccggcgct

SEQ ID NO: 723064 - DNA, 25 bp, Artificial sequence
  Synthetic oligonucleotide
gctcgcaggcgccggcgctgtatgc

SEQ ID NO: 723065 - DNA, 25 bp, Artificial sequence
  Synthetic oligonucleotide
aggcgccggcgctgtatgcgctgtc

SEQ ID NO: 723066 - DNA, 25 bp, Artificial sequence
  Synthetic oligonucleotide
cggcgctgtatgcgctgtcgctgct

SEQ ID NO: 723067 - DNA, 25 bp, Artificial sequence
  Synthetic oligonucleotide
tgtatgcgctgtcgctgctggtggt

SEQ ID NO: 723068 - DNA, 25 bp, Artificial sequence
  Synthetic oligonucleotide
cgctgtcgctgctggtggtgttcct

SEQ ID NO: 723069 - DNA, 25 bp, Artificial sequence
  Synthetic oligonucleotide
cgctgctggtggtgttcctctgcct

SEQ ID NO: 723070 - DNA, 25 bp, Artificial sequence
  Synthetic oligonucleotide
acgtccatgcgcggcctgtccaacg

SEQ ID NO: 723071 - DNA, 25 bp, Artificial sequence
  Synthetic oligonucleotide
cgttctcggtgatgctggtggtgcc

SEQ ID NO: 723072 - DNA, 25 bp, Artificial sequence
  Synthetic oligonucleotide
gcgcaacgacaagggcgagatggtg

SEQ ID NO: 723073 - DNA, 25 bp, Artificial sequence
  Synthetic oligonucleotide
tgcgctgctggcgacgtccatgcgc

SEQ ID NO: 723074 - DNA, 25 bp, Artificial sequence
  Synthetic oligonucleotide
tgatcggtgcgctgctggcgacgtc

SEQ ID NO: 723075 - DNA, 25 bp, Artificial sequence
  Synthetic oligonucleotide
tgggcgtgatcggtgcgctgctggc

SEQ ID NO: 723076 - DNA, 25 bp, Artificial sequence
  Synthetic oligonucleotide
gtgccgttgggcgtgatcggtgcgc

SEQ ID NO: 723077 - DNA, 25 bp, Artificial sequence
  Synthetic oligonucleotide
tggtggtgttcctctgcctggcggc

SEQ ID NO: 723078 - DNA, 25 bp, Artificial sequence
  Synthetic oligonucleotide
cggtgatgctggtggtgccgttggg

SEQ ID NO: 723079 - DNA, 25 bp, Artificial sequence
  Synthetic oligonucleotide
tgttcctctgcctggcggccctgta

SEQ ID NO: 723080 - DNA, 25 bp, Artificial sequence
  Synthetic oligonucleotide
cgattccgttctcggtgatgctggt

SEQ ID NO: 723081 - DNA, 25 bp, Artificial sequence
  Synthetic oligonucleotide
gctggtcgattccgttctcggtgat

SEQ ID NO: 723082 - DNA, 25 bp, Artificial sequence
  Synthetic oligonucleotide
acgaaagctggtcgattccgttctc

SEQ ID NO: 723083 - DNA, 25 bp, Artificial sequence
  Synthetic oligonucleotide
ccctgtacgaaagctggtcgattcc

SEQ ID NO: 723084 - DNA, 25 bp, Artificial sequence
  Synthetic oligonucleotide
tggcggccctgtacgaaagctggtc

SEQ ID NO: 723085 - DNA, 25 bp, Artificial sequence
  Synthetic oligonucleotide
gccgaaaggcgttggctactcctgg

SEQ ID NO: 723086 - DNA, 25 bp, Artificial sequence
  Synthetic oligonucleotide
gctggtggtgccgttgggcgtgatc

SEQ ID NO: 723087 - DNA, 25 bp, Artificial sequence
  Synthetic oligonucleotide
caccggcaagtgggaatacggttcg

SEQ ID NO: 723088 - DNA, 25 bp, Artificial sequence
  Synthetic oligonucleotide
gttggctactcctggaccggcctgt

SEQ ID NO: 723089 - DNA, 25 bp, Artificial sequence
  Synthetic oligonucleotide
agcgctacaatggcgtgccggcgat

SEQ ID NO: 723090 - DNA, 25 bp, Artificial sequence
  Synthetic oligonucleotide
agctggagcgctacaatggcgtgcc

SEQ ID NO: 723091 - DNA, 25 bp, Artificial sequence
  Synthetic oligonucleotide
cgccgaagctggagcgctacaatgg

SEQ ID NO: 723092 - DNA, 25 bp, Artificial sequence
  Synthetic oligonucleotide
acggttcgccgaagctggagcgcta

SEQ ID NO: 723093 - DNA, 25 bp, Artificial sequence
  Synthetic oligonucleotide
gcgtgccggcgatggagatcctcgg

SEQ ID NO: 723094 - DNA, 25 bp, Artificial sequence
  Synthetic oligonucleotide
gcaagtgggaatacggttcgccgaa

SEQ ID NO: 723095 - DNA, 25 bp, Artificial sequence
  Synthetic oligonucleotide
cggcgatggagatcctcggcgagcc

SEQ ID NO: 723096 - DNA, 25 bp, Artificial sequence
  Synthetic oligonucleotide
ttcgccaccggcaagtgggaatacg

SEQ ID NO: 723097 - DNA, 25 bp, Artificial sequence
  Synthetic oligonucleotide
aacgccttcgccaccggcaagtggg

SEQ ID NO: 723098 - DNA, 25 bp, Artificial sequence
  Synthetic oligonucleotide
gccgttcaacgccttcgccaccggc

SEQ ID NO: 723099 - DNA, 25 bp, Artificial sequence
  Synthetic oligonucleotide
gatggtgccgttcaacgccttcgcc

SEQ ID NO: 723100 - DNA, 25 bp, Artificial sequence
  Synthetic oligonucleotide
gggcgagatggtgccgttcaacgcc

SEQ ID NO: 723101 - DNA, 25 bp, Artificial sequence
  Synthetic oligonucleotide
ggcctgtcctacgaggagcgcttgt

SEQ ID NO: 723102 - DNA, 25 bp, Artificial sequence
  Synthetic oligonucleotide
gggaatacggttcgccgaagctgga

SEQ ID NO: 723103 - DNA, 25 bp, Artificial sequence
  Synthetic oligonucleotide
ccggtgacgccatggcggcggtcga

SEQ ID NO: 723104 - DNA, 25 bp, Artificial sequence
  Synthetic oligonucleotide
atgcgcggcctgtccaacgacgtgt

SEQ ID NO: 723105 - DNA, 25 bp, Artificial sequence
  Synthetic oligonucleotide
gcaattgccgaaaggcgttggctac

SEQ ID NO: 723106 - DNA, 25 bp, Artificial sequence
  Synthetic oligonucleotide
cgtcaagcaattgccgaaaggcgtt

SEQ ID NO: 723107 - DNA, 25 bp, Artificial sequence
  Synthetic oligonucleotide
gagatcgtcaagcaattgccgaaag

SEQ ID NO: 723108 - DNA, 25 bp, Artificial sequence
  Synthetic oligonucleotide
gtcgaggagatcgtcaagcaattgc

SEQ ID NO: 723109 - DNA, 25 bp, Artificial sequence
  Synthetic oligonucleotide
acaatggcgtgccggcgatggagat

SEQ ID NO: 723110 - DNA, 25 bp, Artificial sequence
  Synthetic oligonucleotide
cgccatggcggcggtcgaggagatc

SEQ ID NO: 723111 - DNA, 25 bp, Artificial sequence
  Synthetic oligonucleotide
aaggcgttggctactcctggaccgg

SEQ ID NO: 723112 - DNA, 25 bp, Artificial sequence
  Synthetic oligonucleotide
tgagttccggtgacgccatggcggc

SEQ ID NO: 723113 - DNA, 25 bp, Artificial sequence
  Synthetic oligonucleotide
ccggcctgagttccggtgacgccat

SEQ ID NO: 723114 - DNA, 25 bp, Artificial sequence
  Synthetic oligonucleotide
cggcgcccggcctgagttccggtga

SEQ ID NO: 723115 - DNA, 25 bp, Artificial sequence
  Synthetic oligonucleotide
ggcgagccggcgcccggcctgagtt

SEQ ID NO: 723116 - DNA, 25 bp, Artificial sequence
  Synthetic oligonucleotide
gatcctcggcgagccggcgcccggc

SEQ ID NO: 723117 - DNA, 25 bp, Artificial sequence
  Synthetic oligonucleotide
atggagatcctcggcgagccggcgc

SEQ ID NO: 723118 - DNA, 25 bp, Artificial sequence
  Synthetic oligonucleotide
gcggcggtcgaggagatcgtcaagc

SEQ ID NO: 723119 - DNA, 25 bp, Artificial sequence
  Synthetic oligonucleotide
gaccgtcctggcgatcttctgggta

SEQ ID NO: 723120 - DNA, 25 bp, Artificial sequence
  Synthetic oligonucleotide
ctcggcgtggtcccgctggcgatct

SEQ ID NO: 723121 - DNA, 25 bp, Artificial sequence
  Synthetic oligonucleotide
gtggtcccgctggcgatctccaccg

SEQ ID NO: 723122 - DNA, 25 bp, Artificial sequence
  Synthetic oligonucleotide
ccgctggcgatctccaccggcgccg

SEQ ID NO: 723123 - DNA, 25 bp, Artificial sequence
  Synthetic oligonucleotide
gcgatctccaccggcgccggctcgg

SEQ ID NO: 723124 - DNA, 25 bp, Artificial sequence
  Synthetic oligonucleotide
tccaccggcgccggctcgggcagcc

SEQ ID NO: 723125 - DNA, 25 bp, Artificial sequence
  Synthetic oligonucleotide
ggcgccggctcgggcagccagcatg

SEQ ID NO: 723126 - DNA, 25 bp, Artificial sequence
  Synthetic oligonucleotide
gctcgggcagccagcatgcgatcgg

SEQ ID NO: 723127 - DNA, 25 bp, Artificial sequence
  Synthetic oligonucleotide
ggcagccagcatgcgatcggtaccg

SEQ ID NO: 723128 - DNA, 25 bp, Artificial sequence
  Synthetic oligonucleotide
cagcatgcgatcggtaccggcgtga

SEQ ID NO: 723129 - DNA, 25 bp, Artificial sequence
  Synthetic oligonucleotide
gcgatcggtaccggcgtgatcggcg

SEQ ID NO: 723130 - DNA, 25 bp, Artificial sequence
  Synthetic oligonucleotide
ggtaccggcgtgatcggcggcatgg

SEQ ID NO: 723131 - DNA, 25 bp, Artificial sequence
  Synthetic oligonucleotide
ggcgtgatcggcggcatggtcactg

SEQ ID NO: 723132 - DNA, 25 bp, Artificial sequence
  Synthetic oligonucleotide
atcggcggcatggtcactgcgaccg

SEQ ID NO: 723133 - DNA, 25 bp, Artificial sequence
  Synthetic oligonucleotide
ctggcgacgtccatgcgcggcctgt

SEQ ID NO: 723134 - DNA, 25 bp, Artificial sequence
  Synthetic oligonucleotide
gtggcggtcagcacgctgttcaagg

SEQ ID NO: 723135 - DNA, 25 bp, Artificial sequence
  Synthetic oligonucleotide
caggcgtccgtcgaaaaggggcaat

SEQ ID NO: 723136 - DNA, 25 bp, Artificial sequence
  Synthetic oligonucleotide
agcagcaggcgtccgtcgaaaaggg

SEQ ID NO: 723137 - DNA, 25 bp, Artificial sequence
  Synthetic oligonucleotide
cgtccaagcagcaggcgtccgtcga

SEQ ID NO: 723138 - DNA, 25 bp, Artificial sequence
  Synthetic oligonucleotide
gacgaggcgtccaagcagcaggcgt

SEQ ID NO: 723139 - DNA, 25 bp, Artificial sequence
  Synthetic oligonucleotide
ttcaaggacgaggcgtccaagcagc

SEQ ID NO: 723140 - DNA, 25 bp, Artificial sequence
  Synthetic oligonucleotide
ggcatggtcactgcgaccgtcctgg

SEQ ID NO: 723141 - DNA, 25 bp, Artificial sequence
  Synthetic oligonucleotide
gtcagcacgctgttcaaggacgagg

SEQ ID NO: 723142 - DNA, 25 bp, Artificial sequence
  Synthetic oligonucleotide
tcactgcgaccgtcctggcgatctt

SEQ ID NO: 723143 - DNA, 25 bp, Artificial sequence
  Synthetic oligonucleotide
ttctacgtggcggtcagcacgctgt

SEQ ID NO: 723144 - DNA, 25 bp, Artificial sequence
  Synthetic oligonucleotide
accgctgttctacgtggcggtcagc

SEQ ID NO: 723145 - DNA, 25 bp, Artificial sequence
  Synthetic oligonucleotide
ctgggtaccgctgttctacgtggcg

SEQ ID NO: 723146 - DNA, 25 bp, Artificial sequence
  Synthetic oligonucleotide
gatcttctgggtaccgctgttctac

SEQ ID NO: 723147 - DNA, 25 bp, Artificial sequence
  Synthetic oligonucleotide
cctggcgatcttctgggtaccgctg

SEQ ID NO: 723148 - DNA, 25 bp, Artificial sequence
  Synthetic oligonucleotide
cctccctggcgttcatcctcggcgt

SEQ ID NO: 723149 - DNA, 25 bp, Artificial sequence
  Synthetic oligonucleotide
acgctgttcaaggacgaggcgtcca

SEQ ID NO: 723150 - DNA, 25 bp, Artificial sequence
  Synthetic oligonucleotide
tgacgaccatcggcctgtcggcgaa

SEQ ID NO: 723151 - DNA, 25 bp, Artificial sequence
  Synthetic oligonucleotide
ttcatcctcggcgtggtcccgctgg

SEQ ID NO: 723152 - DNA, 25 bp, Artificial sequence
  Synthetic oligonucleotide
tcatcgtggagttcgccaaggagct

SEQ ID NO: 723153 - DNA, 25 bp, Artificial sequence
  Synthetic oligonucleotide
cattctcatcgtggagttcgccaag

SEQ ID NO: 723154 - DNA, 25 bp, Artificial sequence
  Synthetic oligonucleotide
gaacgccattctcatcgtggagttc

SEQ ID NO: 723155 - DNA, 25 bp, Artificial sequence
  Synthetic oligonucleotide
ggcgaagaacgccattctcatcgtg

SEQ ID NO: 723156 - DNA, 25 bp, Artificial sequence
  Synthetic oligonucleotide
tcgccaaggagctgcacgagcaggg

SEQ ID NO: 723157 - DNA, 25 bp, Artificial sequence
  Synthetic oligonucleotide
ccatcggcctgtcggcgaagaacgc

SEQ ID NO: 723158 - DNA, 25 bp, Artificial sequence
  Synthetic oligonucleotide
aggagctgcacgagcagggcaaggg

SEQ ID NO: 723159 - DNA, 25 bp, Artificial sequence
  Synthetic oligonucleotide
gcctgttgacgaccatcggcctgtc

SEQ ID NO: 723160 - DNA, 25 bp, Artificial sequence
  Synthetic oligonucleotide
aggtgggcctgttgacgaccatcgg

SEQ ID NO: 723161 - DNA, 25 bp, Artificial sequence
  Synthetic oligonucleotide
tcttccaggtgggcctgttgacgac

SEQ ID NO: 723162 - DNA, 25 bp, Artificial sequence
  Synthetic oligonucleotide
acgtgttcttccaggtgggcctgtt

SEQ ID NO: 723163 - DNA, 25 bp, Artificial sequence
  Synthetic oligonucleotide
ccaacgacgtgttcttccaggtggg

SEQ ID NO: 723164 - DNA, 25 bp, Artificial sequence
  Synthetic oligonucleotide
gcctgtccaacgacgtgttcttcca

SEQ ID NO: 723165 - DNA, 25 bp, Artificial sequence
  Synthetic oligonucleotide
gcctgtcggcgaagaacgccattct

SEQ ID NO: 723166 - DNA, 25 bp, Artificial sequence
  Synthetic oligonucleotide
catcgaagcctgccgcatgcgtctg

SEQ ID NO: 723167 - DNA, 25 bp, Artificial sequence
  Synthetic oligonucleotide
gtacgtgcgcaacgacaagggcgag

SEQ ID NO: 723168 - DNA, 25 bp, Artificial sequence
  Synthetic oligonucleotide
tgatgacctccctggcgttcatcct

SEQ ID NO: 723169 - DNA, 25 bp, Artificial sequence
  Synthetic oligonucleotide
cgatcgtgatgacctccctggcgtt

SEQ ID NO: 723170 - DNA, 25 bp, Artificial sequence
  Synthetic oligonucleotide
tgcggccgatcgtgatgacctccct

SEQ ID NO: 723171 - DNA, 25 bp, Artificial sequence
  Synthetic oligonucleotide
gcgtctgcggccgatcgtgatgacc

SEQ ID NO: 723172 - DNA, 25 bp, Artificial sequence
  Synthetic oligonucleotide
tggagttcgccaaggagctgcacga

SEQ ID NO: 723173 - DNA, 25 bp, Artificial sequence
  Synthetic oligonucleotide
agcctgccgcatgcgtctgcggccg

SEQ ID NO: 723174 - DNA, 25 bp, Artificial sequence
  Synthetic oligonucleotide
tggcgttcatcctcggcgtggtccc

SEQ ID NO: 723175 - DNA, 25 bp, Artificial sequence
  Synthetic oligonucleotide
ggcggccatcgaagcctgccgcatg

SEQ ID NO: 723176 - DNA, 25 bp, Artificial sequence
  Synthetic oligonucleotide
gtcgaggcggccatcgaagcctgcc

SEQ ID NO: 723177 - DNA, 25 bp, Artificial sequence
  Synthetic oligonucleotide
ggcatcgtcgaggcggccatcgaag

SEQ ID NO: 723178 - DNA, 25 bp, Artificial sequence
  Synthetic oligonucleotide
gcaagggcatcgtcgaggcggccat

SEQ ID NO: 723179 - DNA, 25 bp, Artificial sequence
  Synthetic oligonucleotide
agcagggcaagggcatcgtcgaggc

SEQ ID NO: 723180 - DNA, 25 bp, Artificial sequence
  Synthetic oligonucleotide
tgcacgagcagggcaagggcatcgt

SEQ ID NO: 723181 - DNA, 25 bp, Artificial sequence
  Synthetic oligonucleotide
ccgcatgcgtctgcggccgatcgtg

SEQ ID NO: 723182 - DNA, 25 bp, Artificial sequence
  Synthetic oligonucleotide
aagccctgggaagagcgtcccggtg

SEQ ID NO: 723183 - DNA, 25 bp, Artificial sequence
  Synthetic oligonucleotide
aggaaagctcttcggtcagctcggt

SEQ ID NO: 723184 - DNA, 25 bp, Artificial sequence
  Synthetic oligonucleotide
gctcttcggtcagctcggtgttcac

SEQ ID NO: 723185 - DNA, 25 bp, Artificial sequence
  Synthetic oligonucleotide
ggtcagctcggtgttcaccgtgacc

SEQ ID NO: 723186 - DNA, 25 bp, Artificial sequence
  Synthetic oligonucleotide
tcggtgttcaccgtgaccggcttca

SEQ ID NO: 723187 - DNA, 25 bp, Artificial sequence
  Synthetic oligonucleotide
ttcaccgtgaccggcttcaacttcg

SEQ ID NO: 723188 - DNA, 25 bp, Artificial sequence
  Synthetic oligonucleotide
gtgaccggcttcaacttcgccggcc

SEQ ID NO: 723189 - DNA, 25 bp, Artificial sequence
  Synthetic oligonucleotide
cggcttcaacttcgccggccgcggc

SEQ ID NO: 723190 - DNA, 25 bp, Artificial sequence
  Synthetic oligonucleotide
aacttcgccggccgcggccagagtt

SEQ ID NO: 723191 - DNA, 25 bp, Artificial sequence
  Synthetic oligonucleotide
gccggccgcggccagagttcgggca

SEQ ID NO: 723192 - DNA, 25 bp, Artificial sequence
  Synthetic oligonucleotide
cgcggccagagttcgggcatggcgt

SEQ ID NO: 723193 - DNA, 25 bp, Artificial sequence
  Synthetic oligonucleotide
cagagttcgggcatggcgttcatca

SEQ ID NO: 723194 - DNA, 25 bp, Artificial sequence
  Synthetic oligonucleotide
tcgggcatggcgttcatcatgctca

SEQ ID NO: 723195 - DNA, 25 bp, Artificial sequence
  Synthetic oligonucleotide
atggcgttcatcatgctcaagccct

SEQ ID NO: 723196 - DNA, 25 bp, Artificial sequence
  Synthetic oligonucleotide
aggacgcgatggtgttcgccttcgc

SEQ ID NO: 723197 - DNA, 25 bp, Artificial sequence
  Synthetic oligonucleotide
gcgtgttcgaactggccaagcgcgc

SEQ ID NO: 723198 - DNA, 25 bp, Artificial sequence
  Synthetic oligonucleotide
cgacaagggcgagatggtgccgttc

SEQ ID NO: 723199 - DNA, 25 bp, Artificial sequence
  Synthetic oligonucleotide
tcttcagcttcaaggacgcgatggt

SEQ ID NO: 723200 - DNA, 25 bp, Artificial sequence
  Synthetic oligonucleotide
tgcacttcttcagcttcaaggacgc

SEQ ID NO: 723201 - DNA, 25 bp, Artificial sequence
  Synthetic oligonucleotide
cgcagatgcacttcttcagcttcaa

SEQ ID NO: 723202 - DNA, 25 bp, Artificial sequence
  Synthetic oligonucleotide
agcgcgcgcagatgcacttcttcag

SEQ ID NO: 723203 - DNA, 25 bp, Artificial sequence
  Synthetic oligonucleotide
ttcatcatgctcaagccctgggaag

SEQ ID NO: 723204 - DNA, 25 bp, Artificial sequence
  Synthetic oligonucleotide
tcgaactggccaagcgcgcgcagat

SEQ ID NO: 723205 - DNA, 25 bp, Artificial sequence
  Synthetic oligonucleotide
atgctcaagccctgggaagagcgtc

SEQ ID NO: 723206 - DNA, 25 bp, Artificial sequence
  Synthetic oligonucleotide
agaacagcgtgttcgaactggccaa

SEQ ID NO: 723207 - DNA, 25 bp, Artificial sequence
  Synthetic oligonucleotide
gtggcgagaacagcgtgttcgaact

SEQ ID NO: 723208 - DNA, 25 bp, Artificial sequence
  Synthetic oligonucleotide
tcccggtggcgagaacagcgtgttc

SEQ ID NO: 723209 - DNA, 25 bp, Artificial sequence
  Synthetic oligonucleotide
gagcgtcccggtggcgagaacagcg

SEQ ID NO: 723210 - DNA, 25 bp, Artificial sequence
  Synthetic oligonucleotide
tgggaagagcgtcccggtggcgaga

SEQ ID NO: 723211 - DNA, 25 bp, Artificial sequence
  Synthetic oligonucleotide
gcgaatacctgctggagaaggaaag

SEQ ID NO: 723212 - DNA, 25 bp, Artificial sequence
  Synthetic oligonucleotide
tggccaagcgcgcgcagatgcactt

SEQ ID NO: 723213 - DNA, 25 bp, Artificial sequence
  Synthetic oligonucleotide
tctacgtggtgatcgtggccgggat

SEQ ID NO: 723214 - DNA, 25 bp, Artificial sequence
  Synthetic oligonucleotide
tggagaaggaaagctcttcggtcag

SEQ ID NO: 723215 - DNA, 25 bp, Artificial sequence
  Synthetic oligonucleotide
cacccgcattcccaccgcgttcctc

SEQ ID NO: 723216 - DNA, 25 bp, Artificial sequence
  Synthetic oligonucleotide
gatgttcacccgcattcccaccgcg

SEQ ID NO: 723217 - DNA, 25 bp, Artificial sequence
  Synthetic oligonucleotide
tgatctggatgttcacccgcattcc

SEQ ID NO: 723218 - DNA, 25 bp, Artificial sequence
  Synthetic oligonucleotide
ccgggatgatctggatgttcacccg

SEQ ID NO: 723219 - DNA, 25 bp, Artificial sequence
  Synthetic oligonucleotide
cgcgttcctccccgacgaggaccag

SEQ ID NO: 723220 - DNA, 25 bp, Artificial sequence
  Synthetic oligonucleotide
tggtgatcgtggccgggatgatctg

SEQ ID NO: 723221 - DNA, 25 bp, Artificial sequence
  Synthetic oligonucleotide
ccccgacgaggaccagggcgtactg

SEQ ID NO: 723222 - DNA, 25 bp, Artificial sequence
  Synthetic oligonucleotide
tgctgatctacgtggtgatcgtggc

SEQ ID NO: 723223 - DNA, 25 bp, Artificial sequence
  Synthetic oligonucleotide
cgtacctgctgatctacgtggtgat

SEQ ID NO: 723224 - DNA, 25 bp, Artificial sequence
  Synthetic oligonucleotide
gcgcgccgtacctgctgatctacgt

SEQ ID NO: 723225 - DNA, 25 bp, Artificial sequence
  Synthetic oligonucleotide
aagcatcgcgcgccgtacctgctga

SEQ ID NO: 723226 - DNA, 25 bp, Artificial sequence
  Synthetic oligonucleotide
gatcctcaagcatcgcgcgccgtac

SEQ ID NO: 723227 - DNA, 25 bp, Artificial sequence
  Synthetic oligonucleotide
ggcgtcgatcctcaagcatcgcgcg

SEQ ID NO: 723228 - DNA, 25 bp, Artificial sequence
  Synthetic oligonucleotide
tcgtggccgggatgatctggatgtt

SEQ ID NO: 723229 - DNA, 25 bp, Artificial sequence
  Synthetic oligonucleotide
gctccagtgccgagcgtacccaggt

SEQ ID NO: 723230 - DNA, 25 bp, Artificial sequence
  Synthetic oligonucleotide
gcgatggtgttcgccttcgcgccgc

SEQ ID NO: 723231 - DNA, 25 bp, Artificial sequence
  Synthetic oligonucleotide
cgatgcgcgaatacctgctggagaa

SEQ ID NO: 723232 - DNA, 25 bp, Artificial sequence
  Synthetic oligonucleotide
tggactcgatgcgcgaatacctgct

SEQ ID NO: 723233 - DNA, 25 bp, Artificial sequence
  Synthetic oligonucleotide
tggtggtggactcgatgcgcgaata

SEQ ID NO: 723234 - DNA, 25 bp, Artificial sequence
  Synthetic oligonucleotide
cccaggtggtggtggactcgatgcg

SEQ ID NO: 723235 - DNA, 25 bp, Artificial sequence
  Synthetic oligonucleotide
gcattcccaccgcgttcctccccga

SEQ ID NO: 723236 - DNA, 25 bp, Artificial sequence
  Synthetic oligonucleotide
gtgccgagcgtacccaggtggtggt

SEQ ID NO: 723237 - DNA, 25 bp, Artificial sequence
  Synthetic oligonucleotide
acctgctggagaaggaaagctcttc

SEQ ID NO: 723238 - DNA, 25 bp, Artificial sequence
  Synthetic oligonucleotide
ccgccgggctccagtgccgagcgta

SEQ ID NO: 723239 - DNA, 25 bp, Artificial sequence
  Synthetic oligonucleotide
cagaccccgccgggctccagtgccg

SEQ ID NO: 723240 - DNA, 25 bp, Artificial sequence
  Synthetic oligonucleotide
caggtacagaccccgccgggctcca

SEQ ID NO: 723241 - DNA, 25 bp, Artificial sequence
  Synthetic oligonucleotide
gtactgttcgcccaggtacagaccc

SEQ ID NO: 723242 - DNA, 25 bp, Artificial sequence
  Synthetic oligonucleotide
cagggcgtactgttcgcccaggtac

SEQ ID NO: 723243 - DNA, 25 bp, Artificial sequence
  Synthetic oligonucleotide
gaggaccagggcgtactgttcgccc

SEQ ID NO: 723244 - DNA, 25 bp, Artificial sequence
  Synthetic oligonucleotide
agcgtacccaggtggtggtggactc

SEQ ID NO: 723245 - DNA, 25 bp, Artificial sequence
  Synthetic oligonucleotide
atttcatcgaccgtggccgggtcaa

SEQ ID NO: 723246 - DNA, 25 bp, Artificial sequence
  Synthetic oligonucleotide
tcgacgacgagaaggccagcgccct

SEQ ID NO: 723247 - DNA, 25 bp, Artificial sequence
  Synthetic oligonucleotide
acgagaaggccagcgccctcggcgt

SEQ ID NO: 723248 - DNA, 25 bp, Artificial sequence
  Synthetic oligonucleotide
aggccagcgccctcggcgtgtccct

SEQ ID NO: 723249 - DNA, 25 bp, Artificial sequence
  Synthetic oligonucleotide
gcgccctcggcgtgtcccttgccga

SEQ ID NO: 723250 - DNA, 25 bp, Artificial sequence
  Synthetic oligonucleotide
tcggcgtgtcccttgccgacatcaa

SEQ ID NO: 723251 - DNA, 25 bp, Artificial sequence
  Synthetic oligonucleotide
tgtcccttgccgacatcaacagcac

SEQ ID NO: 723252 - DNA, 25 bp, Artificial sequence
  Synthetic oligonucleotide
ttgccgacatcaacagcaccgtgtc

SEQ ID NO: 723253 - DNA, 25 bp, Artificial sequence
  Synthetic oligonucleotide
gacatcaacagcaccgtgtccatcg

SEQ ID NO: 723254 - DNA, 25 bp, Artificial sequence
  Synthetic oligonucleotide
aacagcaccgtgtccatcgcctggg

SEQ ID NO: 723255 - DNA, 25 bp, Artificial sequence
  Synthetic oligonucleotide
accgtgtccatcgcctggggttcca

SEQ ID NO: 723256 - DNA, 25 bp, Artificial sequence
  Synthetic oligonucleotide
tccatcgcctggggttccagctacg

SEQ ID NO: 723257 - DNA, 25 bp, Artificial sequence
  Synthetic oligonucleotide
cctggggttccagctacgtcaacga

SEQ ID NO: 723258 - DNA, 25 bp, Artificial sequence
  Synthetic oligonucleotide
gttccagctacgtcaacgatttcat

SEQ ID NO: 723259 - DNA, 25 bp, Artificial sequence
  Synthetic oligonucleotide
cttcaaggacgcgatggtgttcgcc

SEQ ID NO: 723260 - DNA, 25 bp, Artificial sequence
  Synthetic oligonucleotide
cagggcaggccggacgcgcggatga

SEQ ID NO: 723261 - DNA, 25 bp, Artificial sequence
  Synthetic oligonucleotide
caagtggtacgtgcgcaacgacaag

SEQ ID NO: 723262 - DNA, 25 bp, Artificial sequence
  Synthetic oligonucleotide
ctgagcaagtggtacgtgcgcaacg

SEQ ID NO: 723263 - DNA, 25 bp, Artificial sequence
  Synthetic oligonucleotide
gacgacctgagcaagtggtacgtgc

SEQ ID NO: 723264 - DNA, 25 bp, Artificial sequence
  Synthetic oligonucleotide
aacccggacgacctgagcaagtggt

SEQ ID NO: 723265 - DNA, 25 bp, Artificial sequence
  Synthetic oligonucleotide
cggatgaacccggacgacctgagca

SEQ ID NO: 723266 - DNA, 25 bp, Artificial sequence
  Synthetic oligonucleotide
gctacgtcaacgatttcatcgaccg

SEQ ID NO: 723267 - DNA, 25 bp, Artificial sequence
  Synthetic oligonucleotide
aggccggacgcgcggatgaacccgg

SEQ ID NO: 723268 - DNA, 25 bp, Artificial sequence
  Synthetic oligonucleotide
tcaacgatttcatcgaccgtggccg

SEQ ID NO: 723269 - DNA, 25 bp, Artificial sequence
  Synthetic oligonucleotide
tacctgcagggcaggccggacgcgc

SEQ ID NO: 723270 - DNA, 25 bp, Artificial sequence
  Synthetic oligonucleotide
cgggtctacctgcagggcaggccgg

SEQ ID NO: 723271 - DNA, 25 bp, Artificial sequence
  Synthetic oligonucleotide
gtcaagcgggtctacctgcagggca

SEQ ID NO: 723272 - DNA, 25 bp, Artificial sequence
  Synthetic oligonucleotide
tggccgggtcaagcgggtctacctg

SEQ ID NO: 723273 - DNA, 25 bp, Artificial sequence
  Synthetic oligonucleotide
atcgaccgtggccgggtcaagcggg

SEQ ID NO: 723274 - DNA, 25 bp, Artificial sequence
  Synthetic oligonucleotide
cgcagtacaagctggagatcgacga

SEQ ID NO: 723275 - DNA, 25 bp, Artificial sequence
  Synthetic oligonucleotide
gacgcgcggatgaacccggacgacc

SEQ ID NO: 723276 - DNA, 25 bp, Artificial sequence
  Synthetic oligonucleotide
caccggcttcgacctgttcctccag

SEQ ID NO: 723277 - DNA, 25 bp, Artificial sequence
  Synthetic oligonucleotide
tggagatcgacgacgagaaggccag

SEQ ID NO: 723278 - DNA, 25 bp, Artificial sequence
  Synthetic oligonucleotide
tcggccacgaagtcctgctccaggc

SEQ ID NO: 723279 - DNA, 25 bp, Artificial sequence
  Synthetic oligonucleotide
cgggtgtcggccacgaagtcctgct

SEQ ID NO: 723280 - DNA, 25 bp, Artificial sequence
  Synthetic oligonucleotide
gaccaggcgggtgtcggccacgaag

SEQ ID NO: 723281 - DNA, 25 bp, Artificial sequence
  Synthetic oligonucleotide
ctccaggaccaggcgggtgtcggcc

SEQ ID NO: 723282 - DNA, 25 bp, Artificial sequence
  Synthetic oligonucleotide
tcctgctccaggcgcgcaacaagtt

SEQ ID NO: 723283 - DNA, 25 bp, Artificial sequence
  Synthetic oligonucleotide
ttcgacctgttcctccaggaccagg

SEQ ID NO: 723284 - DNA, 25 bp, Artificial sequence
  Synthetic oligonucleotide
tccaggcgcgcaacaagttcctcat

SEQ ID NO: 723285 - DNA, 25 bp, Artificial sequence
  Synthetic oligonucleotide
taacgccaccggcttcgacctgttc

SEQ ID NO: 723286 - DNA, 25 bp, Artificial sequence
  Synthetic oligonucleotide
ctggaactgggtaacgccaccggct

SEQ ID NO: 723287 - DNA, 25 bp, Artificial sequence
  Synthetic oligonucleotide
tcggtactggaactgggtaacgcca

SEQ ID NO: 723288 - DNA, 25 bp, Artificial sequence
  Synthetic oligonucleotide
cgccgccgtcggtactggaactggg

SEQ ID NO: 723289 - DNA, 25 bp, Artificial sequence
  Synthetic oligonucleotide
ccttcgcgccgccgtcggtactgga

SEQ ID NO: 723290 - DNA, 25 bp, Artificial sequence
  Synthetic oligonucleotide
gtgttcgccttcgcgccgccgtcgg

SEQ ID NO: 723291 - DNA, 25 bp, Artificial sequence
  Synthetic oligonucleotide
ctgttcctccaggaccaggcgggtg

SEQ ID NO: 723292 - DNA, 25 bp, Artificial sequence
  Synthetic oligonucleotide
cggcgctgcaacgcgtgcgccccaa

SEQ ID NO: 723293 - DNA, 25 bp, Artificial sequence
  Synthetic oligonucleotide
ggcgtggcgtcgatcctcaagcatc

SEQ ID NO: 723294 - DNA, 25 bp, Artificial sequence
  Synthetic oligonucleotide
acgaaccgcagtacaagctggagat

SEQ ID NO: 723295 - DNA, 25 bp, Artificial sequence
  Synthetic oligonucleotide
tgagcgacgaaccgcagtacaagct

SEQ ID NO: 723296 - DNA, 25 bp, Artificial sequence
  Synthetic oligonucleotide
acggcatgagcgacgaaccgcagta

SEQ ID NO: 723297 - DNA, 25 bp, Artificial sequence
  Synthetic oligonucleotide
gccccaacggcatgagcgacgaacc

SEQ ID NO: 723298 - DNA, 25 bp, Artificial sequence
  Synthetic oligonucleotide
acgaagtcctgctccaggcgcgcaa

SEQ ID NO: 723299 - DNA, 25 bp, Artificial sequence
  Synthetic oligonucleotide
tgcaacgcgtgcgccccaacggcat

SEQ ID NO: 723300 - DNA, 25 bp, Artificial sequence
  Synthetic oligonucleotide
acaagctggagatcgacgacgagaa

SEQ ID NO: 723301 - DNA, 25 bp, Artificial sequence
  Synthetic oligonucleotide
agaacccggcgctgcaacgcgtgcg

SEQ ID NO: 723302 - DNA, 25 bp, Artificial sequence
  Synthetic oligonucleotide
gccgcgcagaacccggcgctgcaac

SEQ ID NO: 723303 - DNA, 25 bp, Artificial sequence
  Synthetic oligonucleotide
atgctcgccgcgcagaacccggcgc

SEQ ID NO: 723304 - DNA, 25 bp, Artificial sequence
  Synthetic oligonucleotide
gttcctcatgctcgccgcgcagaac

SEQ ID NO: 723305 - DNA, 25 bp, Artificial sequence
  Synthetic oligonucleotide
aacaagttcctcatgctcgccgcgc

SEQ ID NO: 723306 - DNA, 25 bp, Artificial sequence
  Synthetic oligonucleotide
gcgcgcaacaagttcctcatgctcg

SEQ ID NO: 723307 - DNA, 25 bp, Artificial sequence
  Synthetic oligonucleotide
gcgtgcgccccaacggcatgagcga

SEQ ID NO: 723308 - DNA, 25 bp, Artificial sequence
  Synthetic oligonucleotide
catcaagatggacctcggcccggca

SEQ ID NO: 723309 - DNA, 25 bp, Artificial sequence
  Synthetic oligonucleotide
tcaccatcaaggccaagctgatcgg

SEQ ID NO: 723310 - DNA, 25 bp, Artificial sequence
  Synthetic oligonucleotide
tcaaggccaagctgatcggccaggg

SEQ ID NO: 723311 - DNA, 25 bp, Artificial sequence
  Synthetic oligonucleotide
ccaagctgatcggccagggcgacga

SEQ ID NO: 723312 - DNA, 25 bp, Artificial sequence
  Synthetic oligonucleotide
tgatcggccagggcgacgacccgtg

SEQ ID NO: 723313 - DNA, 25 bp, Artificial sequence
  Synthetic oligonucleotide
cagggcgacgacccgtggggcggct

SEQ ID NO: 723314 - DNA, 25 bp, Artificial sequence
  Synthetic oligonucleotide
ccgtggggcggctaccgtgccggct

SEQ ID NO: 723315 - DNA, 25 bp, Artificial sequence
  Synthetic oligonucleotide
ggcggctaccgtgccggcttcgaag

SEQ ID NO: 723316 - DNA, 25 bp, Artificial sequence
  Synthetic oligonucleotide
taccgtgccggcttcgaaggcagcg

SEQ ID NO: 723317 - DNA, 25 bp, Artificial sequence
  Synthetic oligonucleotide
ccggcttcgaaggcagcgccaccct

SEQ ID NO: 723318 - DNA, 25 bp, Artificial sequence
  Synthetic oligonucleotide
tcgaaggcagcgccaccctgaagct

SEQ ID NO: 723319 - DNA, 25 bp, Artificial sequence
  Synthetic oligonucleotide
gcagcgccaccctgaagctgaaaga

SEQ ID NO: 723320 - DNA, 25 bp, Artificial sequence
  Synthetic oligonucleotide
ccaccctgaagctgaaagacttcgg

SEQ ID NO: 723321 - DNA, 25 bp, Artificial sequence
  Synthetic oligonucleotide
tgaagctgaaagacttcggcatcaa

SEQ ID NO: 723322 - DNA, 25 bp, Artificial sequence
  Synthetic oligonucleotide
cgccggcgatcgccggcgtttttca

SEQ ID NO: 723323 - DNA, 25 bp, Artificial sequence
  Synthetic oligonucleotide
gagctgctgctctccgtcgaaggca

SEQ ID NO: 723324 - DNA, 25 bp, Artificial sequence
  Synthetic oligonucleotide
tcaggtcgagtcgctggcaatcgag

SEQ ID NO: 723325 - DNA, 25 bp, Artificial sequence
  Synthetic oligonucleotide
ctgaaacgaaaaacgccggcgatcg

SEQ ID NO: 723326 - DNA, 25 bp, Artificial sequence
  Synthetic oligonucleotide
cagtaagcggatacctgaaacgaaa

SEQ ID NO: 723327 - DNA, 25 bp, Artificial sequence
  Synthetic oligonucleotide
attcgccagtaagcggatacctgaa

SEQ ID NO: 723328 - DNA, 25 bp, Artificial sequence
  Synthetic oligonucleotide
aaggcattcgccagtaagcggatac

SEQ ID NO: 723329 - DNA, 25 bp, Artificial sequence
  Synthetic oligonucleotide
gaaagacttcggcatcaagatggac

SEQ ID NO: 723330 - DNA, 25 bp, Artificial sequence
  Synthetic oligonucleotide
tgctctccgtcgaaggcattcgcca

SEQ ID NO: 723331 - DNA, 25 bp, Artificial sequence
  Synthetic oligonucleotide
cttcggcatcaagatggacctcggc

SEQ ID NO: 723332 - DNA, 25 bp, Artificial sequence
  Synthetic oligonucleotide
gaagtcgagctgctgctctccgtcg

SEQ ID NO: 723333 - DNA, 25 bp, Artificial sequence
  Synthetic oligonucleotide
tcccaggaagtcgagctgctgctct

SEQ ID NO: 723334 - DNA, 25 bp, Artificial sequence
  Synthetic oligonucleotide
cccggcatcccaggaagtcgagctg

SEQ ID NO: 723335 - DNA, 25 bp, Artificial sequence
  Synthetic oligonucleotide
cctcggcccggcatcccaggaagtc

SEQ ID NO: 723336 - DNA, 25 bp, Artificial sequence
  Synthetic oligonucleotide
gatggacctcggcccggcatcccag

SEQ ID NO: 723337 - DNA, 25 bp, Artificial sequence
  Synthetic oligonucleotide
acggcgtgaccaagccggtcaccat

SEQ ID NO: 723338 - DNA, 25 bp, Artificial sequence
  Synthetic oligonucleotide
ccgtcgaaggcattcgccagtaagc

SEQ ID NO: 723339 - DNA, 25 bp, Artificial sequence
  Synthetic oligonucleotide
gcgtggacaccaaccatgccgagcg

SEQ ID NO: 723340 - DNA, 25 bp, Artificial sequence
  Synthetic oligonucleotide
agccggtcaccatcaaggccaagct

SEQ ID NO: 723341 - DNA, 25 bp, Artificial sequence
  Synthetic oligonucleotide
tgcgcagcggtgatttcctcaacgt

SEQ ID NO: 723342 - DNA, 25 bp, Artificial sequence
  Synthetic oligonucleotide
agcacctgcgcagcggtgatttcct

SEQ ID NO: 723343 - DNA, 25 bp, Artificial sequence
  Synthetic oligonucleotide
gtgacaagcacctgcgcagcggtga

SEQ ID NO: 723344 - DNA, 25 bp, Artificial sequence
  Synthetic oligonucleotide
gccgagcgtgacaagcacctgcgca

SEQ ID NO: 723345 - DNA, 25 bp, Artificial sequence
  Synthetic oligonucleotide
atttcctcaacgtcagcaagaaccc

SEQ ID NO: 723346 - DNA, 25 bp, Artificial sequence
  Synthetic oligonucleotide
acaccaaccatgccgagcgtgacaa

SEQ ID NO: 723347 - DNA, 25 bp, Artificial sequence
  Synthetic oligonucleotide
tcaacgtcagcaagaacccgaccgc

SEQ ID NO: 723348 - DNA, 25 bp, Artificial sequence
  Synthetic oligonucleotide
ccaacagcgtggacaccaaccatgc

SEQ ID NO: 723349 - DNA, 25 bp, Artificial sequence
  Synthetic oligonucleotide
tcaacaccaacagcgtggacaccaa

SEQ ID NO: 723350 - DNA, 25 bp, Artificial sequence
  Synthetic oligonucleotide
gaccatcaacaccaacagcgtggac

SEQ ID NO: 723351 - DNA, 25 bp, Artificial sequence
  Synthetic oligonucleotide
caaggtgaccatcaacaccaacagc

SEQ ID NO: 723352 - DNA, 25 bp, Artificial sequence
  Synthetic oligonucleotide
caaggtcaaggtgaccatcaacacc

SEQ ID NO: 723353 - DNA, 25 bp, Artificial sequence
  Synthetic oligonucleotide
ggccgacaaggtcaaggtgaccatc

SEQ ID NO: 723354 - DNA, 25 bp, Artificial sequence
  Synthetic oligonucleotide
accatgccgagcgtgacaagcacct

SEQ ID NO: 723355 - DNA, 25 bp, Artificial sequence
  Synthetic oligonucleotide
aggccaacggcgacagcgccgacat

SEQ ID NO: 723356 - DNA, 25 bp, Artificial sequence
  Synthetic oligonucleotide
cgatcgccggcgtttttcattgtgc

SEQ ID NO: 723357 - DNA, 25 bp, Artificial sequence
  Synthetic oligonucleotide
ccctgaacggcgtgaccaagccggt

SEQ ID NO: 723358 - DNA, 25 bp, Artificial sequence
  Synthetic oligonucleotide
aacctgaccctgaacggcgtgacca

SEQ ID NO: 723359 - DNA, 25 bp, Artificial sequence
  Synthetic oligonucleotide
caccggcaacctgaccctgaacggc

SEQ ID NO: 723360 - DNA, 25 bp, Artificial sequence
  Synthetic oligonucleotide
cgacatcaccggcaacctgaccctg

SEQ ID NO: 723361 - DNA, 25 bp, Artificial sequence
  Synthetic oligonucleotide
gcggtgatttcctcaacgtcagcaa

SEQ ID NO: 723362 - DNA, 25 bp, Artificial sequence
  Synthetic oligonucleotide
acggcgacagcgccgacatcaccgg

SEQ ID NO: 723363 - DNA, 25 bp, Artificial sequence
  Synthetic oligonucleotide
tgaccaagccggtcaccatcaaggc

SEQ ID NO: 723364 - DNA, 25 bp, Artificial sequence
  Synthetic oligonucleotide
gaagtgaaggccaacggcgacagcg

SEQ ID NO: 723365 - DNA, 25 bp, Artificial sequence
  Synthetic oligonucleotide
tccaccgaagtgaaggccaacggcg

SEQ ID NO: 723366 - DNA, 25 bp, Artificial sequence
  Synthetic oligonucleotide
ttcgaatccaccgaagtgaaggcca

SEQ ID NO: 723367 - DNA, 25 bp, Artificial sequence
  Synthetic oligonucleotide
gctaccttcgaatccaccgaagtga

SEQ ID NO: 723368 - DNA, 25 bp, Artificial sequence
  Synthetic oligonucleotide
ccgaccgctaccttcgaatccaccg

SEQ ID NO: 723369 - DNA, 25 bp, Artificial sequence
  Synthetic oligonucleotide
tcagcaagaacccgaccgctacctt

SEQ ID NO: 723370 - DNA, 25 bp, Artificial sequence
  Synthetic oligonucleotide
acagcgccgacatcaccggcaacct

SEQ ID NO: 723371 - DNA, 25 bp, Artificial sequence
  Synthetic oligonucleotide
tcgcggcacatctggcgtcccaggt

SEQ ID NO: 723372 - DNA, 25 bp, Artificial sequence
  Synthetic oligonucleotide
gagctggaagctgcgctggtcgctg

SEQ ID NO: 723373 - DNA, 25 bp, Artificial sequence
  Synthetic oligonucleotide
gaagctgcgctggtcgctggggttg

SEQ ID NO: 723374 - DNA, 25 bp, Artificial sequence
  Synthetic oligonucleotide
gcgctggtcgctggggttgcgctcg

SEQ ID NO: 723375 - DNA, 25 bp, Artificial sequence
  Synthetic oligonucleotide
gtcgctggggttgcgctcgcggcgg

SEQ ID NO: 723376 - DNA, 25 bp, Artificial sequence
  Synthetic oligonucleotide
tggggttgcgctcgcggcggaccag

SEQ ID NO: 723377 - DNA, 25 bp, Artificial sequence
  Synthetic oligonucleotide
tgcgctcgcggcggaccaggtttct

SEQ ID NO: 723378 - DNA, 25 bp, Artificial sequence
  Synthetic oligonucleotide
gcggaccaggtttcttccctccagc

SEQ ID NO: 723379 - DNA, 25 bp, Artificial sequence
  Synthetic oligonucleotide
aggtttcttccctccagctcgcgga

SEQ ID NO: 723380 - DNA, 25 bp, Artificial sequence
  Synthetic oligonucleotide
ttccctccagctcgcggatcttccg

SEQ ID NO: 723381 - DNA, 25 bp, Artificial sequence
  Synthetic oligonucleotide
ccagctcgcggatcttccgggtgat

SEQ ID NO: 723382 - DNA, 25 bp, Artificial sequence
  Synthetic oligonucleotide
cgcggatcttccgggtgatcagtgc

SEQ ID NO: 723383 - DNA, 25 bp, Artificial sequence
  Synthetic oligonucleotide
tcttccgggtgatcagtgccttgtc

SEQ ID NO: 723384 - DNA, 25 bp, Artificial sequence
  Synthetic oligonucleotide
gggtgatcagtgccttgtcgcggca

SEQ ID NO: 723385 - DNA, 25 bp, Artificial sequence
  Synthetic oligonucleotide
cgaaaaacgccggcgatcgccggcg

SEQ ID NO: 723386 - DNA, 25 bp, Artificial sequence
  Synthetic oligonucleotide
agcccgcgttgttcgtcgataagct

SEQ ID NO: 723387 - DNA, 25 bp, Artificial sequence
  Synthetic oligonucleotide
gcggggtcaggtcgagtcgctggca

SEQ ID NO: 723388 - DNA, 25 bp, Artificial sequence
  Synthetic oligonucleotide
cgtcgggcggggtcaggtcgagtcg

SEQ ID NO: 723389 - DNA, 25 bp, Artificial sequence
  Synthetic oligonucleotide
tacatggacgtcgggcggggtcagg

SEQ ID NO: 723390 - DNA, 25 bp, Artificial sequence
  Synthetic oligonucleotide
cttcaatacatggacgtcgggcggg

SEQ ID NO: 723391 - DNA, 25 bp, Artificial sequence
  Synthetic oligonucleotide
ataagcttcaatacatggacgtcgg

SEQ ID NO: 723392 - DNA, 25 bp, Artificial sequence
  Synthetic oligonucleotide
tcagtgccttgtcgcggcacatctg

SEQ ID NO: 723393 - DNA, 25 bp, Artificial sequence
  Synthetic oligonucleotide
cgttgttcgtcgataagcttcaata

SEQ ID NO: 723394 - DNA, 25 bp, Artificial sequence
  Synthetic oligonucleotide
gccttgtcgcggcacatctggcgtc

SEQ ID NO: 723395 - DNA, 25 bp, Artificial sequence
  Synthetic oligonucleotide
aggttcagcccgcgttgttcgtcga

SEQ ID NO: 723396 - DNA, 25 bp, Artificial sequence
  Synthetic oligonucleotide
tcctgcaggttcagcccgcgttgtt

SEQ ID NO: 723397 - DNA, 25 bp, Artificial sequence
  Synthetic oligonucleotide
cccaggtcctgcaggttcagcccgc

SEQ ID NO: 723398 - DNA, 25 bp, Artificial sequence
  Synthetic oligonucleotide
tggcgtcccaggtcctgcaggttca

SEQ ID NO: 723399 - DNA, 25 bp, Artificial sequence
  Synthetic oligonucleotide
cacatctggcgtcccaggtcctgca

SEQ ID NO: 723400 - DNA, 25 bp, Artificial sequence
  Synthetic oligonucleotide
ccctcgtcggtgaggaagagctgga

SEQ ID NO: 723401 - DNA, 25 bp, Artificial sequence
  Synthetic oligonucleotide
tcgtcgataagcttcaatacatgga

SEQ ID NO: 723402 - DNA, 25 bp, Artificial sequence
  Synthetic oligonucleotide
taaatatcctcaagcggttgcgcgg

SEQ ID NO: 723403 - DNA, 25 bp, Artificial sequence
  Synthetic oligonucleotide
aggaagagctggaagctgcgctggt

SEQ ID NO: 723404 - DNA, 25 bp, Artificial sequence
  Synthetic oligonucleotide
gtcgaggagatgcaccagggtggcc

SEQ ID NO: 723405 - DNA, 25 bp, Artificial sequence
  Synthetic oligonucleotide
gcactggtcgaggagatgcaccagg

SEQ ID NO: 723406 - DNA, 25 bp, Artificial sequence
  Synthetic oligonucleotide
ggccaggcactggtcgaggagatgc

SEQ ID NO: 723407 - DNA, 25 bp, Artificial sequence
  Synthetic oligonucleotide
gttgcgcggccaggcactggtcgag

SEQ ID NO: 723408 - DNA, 25 bp, Artificial sequence
  Synthetic oligonucleotide
caccagggtggcctgttccaccggg

SEQ ID NO: 723409 - DNA, 25 bp, Artificial sequence
  Synthetic oligonucleotide
tcctcaagcggttgcgcggccaggc

SEQ ID NO: 723410 - DNA, 25 bp, Artificial sequence
  Synthetic oligonucleotide
ggtggcctgttccaccggggtgagc

SEQ ID NO: 723411 - DNA, 25 bp, Artificial sequence
  Synthetic oligonucleotide
tgttcttaaatatcctcaagcggtt

SEQ ID NO: 723412 - DNA, 25 bp, Artificial sequence
  Synthetic oligonucleotide
aaagaatgttcttaaatatcctcaa

SEQ ID NO: 723413 - DNA, 25 bp, Artificial sequence
  Synthetic oligonucleotide
cttcgaaaagaatgttcttaaatat

SEQ ID NO: 723414 - DNA, 25 bp, Artificial sequence
  Synthetic oligonucleotide
attgtgcttcgaaaagaatgttctt

SEQ ID NO: 723415 - DNA, 25 bp, Artificial sequence
  Synthetic oligonucleotide
tttttcattgtgcttcgaaaagaat

SEQ ID NO: 723416 - DNA, 25 bp, Artificial sequence
  Synthetic oligonucleotide
ccggcgtttttcattgtgcttcgaa

SEQ ID NO: 723417 - DNA, 25 bp, Artificial sequence
  Synthetic oligonucleotide
aagcggttgcgcggccaggcactgg

SEQ ID NO: 723418 - DNA, 25 bp, Artificial sequence
  Synthetic oligonucleotide
gcacgcgtgacatgatggcctccgc

SEQ ID NO: 723419 - DNA, 25 bp, Artificial sequence
  Synthetic oligonucleotide
tcaccttcgacgagaagaacccgtc

SEQ ID NO: 723420 - DNA, 25 bp, Artificial sequence
  Synthetic oligonucleotide
gccagcccctcgtcggtgaggaaga

SEQ ID NO: 723421 - DNA, 25 bp, Artificial sequence
  Synthetic oligonucleotide
gtggatggccagcccctcgtcggtg

SEQ ID NO: 723422 - DNA, 25 bp, Artificial sequence
  Synthetic oligonucleotide
atgctggtggatggccagcccctcg

SEQ ID NO: 723423 - DNA, 25 bp, Artificial sequence
  Synthetic oligonucleotide
ctccgcatgctggtggatggccagc

SEQ ID NO: 723424 - DNA, 25 bp, Artificial sequence
  Synthetic oligonucleotide
agatgcaccagggtggcctgttcca

SEQ ID NO: 723425 - DNA, 25 bp, Artificial sequence
  Synthetic oligonucleotide
tgacatgatggcctccgcatgctgg

SEQ ID NO: 723426 - DNA, 25 bp, Artificial sequence
  Synthetic oligonucleotide
tcggtgaggaagagctggaagctgc

SEQ ID NO: 723427 - DNA, 25 bp, Artificial sequence
  Synthetic oligonucleotide
cgtcatgcacgcgtgacatgatggc

SEQ ID NO: 723428 - DNA, 25 bp, Artificial sequence
  Synthetic oligonucleotide
caactcgtcatgcacgcgtgacatg

SEQ ID NO: 723429 - DNA, 25 bp, Artificial sequence
  Synthetic oligonucleotide
ggcaaacaactcgtcatgcacgcgt

SEQ ID NO: 723430 - DNA, 25 bp, Artificial sequence
  Synthetic oligonucleotide
gagcggggcaaacaactcgtcatgc

SEQ ID NO: 723431 - DNA, 25 bp, Artificial sequence
  Synthetic oligonucleotide
cggggtgagcggggcaaacaactcg

SEQ ID NO: 723432 - DNA, 25 bp, Artificial sequence
  Synthetic oligonucleotide
tgttccaccggggtgagcggggcaa

SEQ ID NO: 723433 - DNA, 25 bp, Artificial sequence
  Synthetic oligonucleotide
gatggcctccgcatgctggtggatg

SEQ ID NO: 723434 - DNA, 25 bp, Artificial sequence
  Synthetic oligonucleotide
tgtacgggctgctgctggcggtgat

SEQ ID NO: 723435 - DNA, 25 bp, Artificial sequence
  Synthetic oligonucleotide
atcgtctggcgtttcgtcagcccgc

SEQ ID NO: 723436 - DNA, 25 bp, Artificial sequence
  Synthetic oligonucleotide
tggcgtttcgtcagcccgccgccgc

SEQ ID NO: 723437 - DNA, 25 bp, Artificial sequence
  Synthetic oligonucleotide
ttcgtcagcccgccgccgccggcgc

SEQ ID NO: 723438 - DNA, 25 bp, Artificial sequence
  Synthetic oligonucleotide
agcccgccgccgccggcgccggcca

SEQ ID NO: 723439 - DNA, 25 bp, Artificial sequence
  Synthetic oligonucleotide
ccgccgccggcgccggccaaccacg

SEQ ID NO: 723440 - DNA, 25 bp, Artificial sequence
  Synthetic oligonucleotide
cggcgccggccaaccacggtccgct

SEQ ID NO: 723441 - DNA, 25 bp, Artificial sequence
  Synthetic oligonucleotide
cggccaaccacggtccgctcacgcg

SEQ ID NO: 723442 - DNA, 25 bp, Artificial sequence
  Synthetic oligonucleotide
aaccacggtccgctcacgcgggtag

SEQ ID NO: 723443 - DNA, 25 bp, Artificial sequence
  Synthetic oligonucleotide
ggtccgctcacgcgggtagcgagca

SEQ ID NO: 723444 - DNA, 25 bp, Artificial sequence
  Synthetic oligonucleotide
ctcacgcgggtagcgagcaagcttg

SEQ ID NO: 723445 - DNA, 25 bp, Artificial sequence
  Synthetic oligonucleotide
cgggtagcgagcaagcttggccacc

SEQ ID NO: 723446 - DNA, 25 bp, Artificial sequence
  Synthetic oligonucleotide
agcgagcaagcttggccacctcgcg

SEQ ID NO: 723447 - DNA, 25 bp, Artificial sequence
  Synthetic oligonucleotide
aagcttggccacctcgcgctgtacg

SEQ ID NO: 723448 - DNA, 25 bp, Artificial sequence
  Synthetic oligonucleotide
cccgtcggccgacaaggtcaaggtg

SEQ ID NO: 723449 - DNA, 25 bp, Artificial sequence
  Synthetic oligonucleotide
tacctgatttccaccgccgacggcg

SEQ ID NO: 723450 - DNA, 25 bp, Artificial sequence
  Synthetic oligonucleotide
tggttctccgtgccggcaaccctca

SEQ ID NO: 723451 - DNA, 25 bp, Artificial sequence
  Synthetic oligonucleotide
ttcggctggttctccgtgccggcaa

SEQ ID NO: 723452 - DNA, 25 bp, Artificial sequence
  Synthetic oligonucleotide
agcgtgttcggctggttctccgtgc

SEQ ID NO: 723453 - DNA, 25 bp, Artificial sequence
  Synthetic oligonucleotide
ccgatcagcgtgttcggctggttct

SEQ ID NO: 723454 - DNA, 25 bp, Artificial sequence
  Synthetic oligonucleotide
ggcgaaccgatcagcgtgttcggct

SEQ ID NO: 723455 - DNA, 25 bp, Artificial sequence
  Synthetic oligonucleotide
gccacctcgcgctgtacgggctgct

SEQ ID NO: 723456 - DNA, 25 bp, Artificial sequence
  Synthetic oligonucleotide
ttccaccgccgacggcgaaccgatc

SEQ ID NO: 723457 - DNA, 25 bp, Artificial sequence
  Synthetic oligonucleotide
tcgcgctgtacgggctgctgctggc

SEQ ID NO: 723458 - DNA, 25 bp, Artificial sequence
  Synthetic oligonucleotide
gcgggctacctgatttccaccgccg

SEQ ID NO: 723459 - DNA, 25 bp, Artificial sequence
  Synthetic oligonucleotide
atcgtcgcgggctacctgatttcca

SEQ ID NO: 723460 - DNA, 25 bp, Artificial sequence
  Synthetic oligonucleotide
gcggtgatcgtcgcgggctacctga

SEQ ID NO: 723461 - DNA, 25 bp, Artificial sequence
  Synthetic oligonucleotide
ctgctggcggtgatcgtcgcgggct

SEQ ID NO: 723462 - DNA, 25 bp, Artificial sequence
  Synthetic oligonucleotide
gggctgctgctggcggtgatcgtcg

SEQ ID NO: 723463 - DNA, 25 bp, Artificial sequence
  Synthetic oligonucleotide
ttgccctgctggtgcggatcgtctg

SEQ ID NO: 723464 - DNA, 25 bp, Artificial sequence
  Synthetic oligonucleotide
cgccgacggcgaaccgatcagcgtg

SEQ ID NO: 723465 - DNA, 25 bp, Artificial sequence
  Synthetic oligonucleotide
gtattcagcctgttcctgcactggg

SEQ ID NO: 723466 - DNA, 25 bp, Artificial sequence
  Synthetic oligonucleotide
tgcggatcgtctggcgtttcgtcag

SEQ ID NO: 723467 - DNA, 25 bp, Artificial sequence
  Synthetic oligonucleotide
tggtcttcggcctgttcggcctggg

SEQ ID NO: 723468 - DNA, 25 bp, Artificial sequence
  Synthetic oligonucleotide
cgctggtggtcttcggcctgttcgg

SEQ ID NO: 723469 - DNA, 25 bp, Artificial sequence
  Synthetic oligonucleotide
ggcagcgcgctggtggtcttcggcc

SEQ ID NO: 723470 - DNA, 25 bp, Artificial sequence
  Synthetic oligonucleotide
cactggggcagcgcgctggtggtct

SEQ ID NO: 723471 - DNA, 25 bp, Artificial sequence
  Synthetic oligonucleotide
tgttcggcctgggcctgtggatgcg

SEQ ID NO: 723472 - DNA, 25 bp, Artificial sequence
  Synthetic oligonucleotide
agcctgttcctgcactggggcagcg

SEQ ID NO: 723473 - DNA, 25 bp, Artificial sequence
  Synthetic oligonucleotide
gcctgggcctgtggatgcgcgaact

SEQ ID NO: 723474 - DNA, 25 bp, Artificial sequence
  Synthetic oligonucleotide
taggcccattttcgcgtgggtgatc

SEQ ID NO: 723475 - DNA, 25 bp, Artificial sequence
  Synthetic oligonucleotide
ccgttacggcgtattcagcctgttc

SEQ ID NO: 723476 - DNA, 25 bp, Artificial sequence
  Synthetic oligonucleotide
atctggctcgacccggccaagctga

SEQ ID NO: 723477 - DNA, 25 bp, Artificial sequence
  Synthetic oligonucleotide
aatacctcatcccgttacggcgtat

SEQ ID NO: 723478 - DNA, 25 bp, Artificial sequence
  Synthetic oligonucleotide
tggcgcaatacctcatcccgttacg

SEQ ID NO: 723479 - DNA, 25 bp, Artificial sequence
  Synthetic oligonucleotide
atgcagtggcgcaatacctcatccc

SEQ ID NO: 723480 - DNA, 25 bp, Artificial sequence
  Synthetic oligonucleotide
ttcctgcactggggcagcgcgctgg

SEQ ID NO: 723481 - DNA, 25 bp, Artificial sequence
  Synthetic oligonucleotide
ccgcgccggcgctgcataaaagcat

SEQ ID NO: 723482 - DNA, 25 bp, Artificial sequence
  Synthetic oligonucleotide
ccctcagcgggctgcccgaccaggc

SEQ ID NO: 723483 - DNA, 25 bp, Artificial sequence
  Synthetic oligonucleotide
tggccattgccctgctggtgcggat

SEQ ID NO: 723484 - DNA, 25 bp, Artificial sequence
  Synthetic oligonucleotide
tcctgctggccattgccctgctggt

SEQ ID NO: 723485 - DNA, 25 bp, Artificial sequence
  Synthetic oligonucleotide
tcggcatcctgctggccattgccct

SEQ ID NO: 723486 - DNA, 25 bp, Artificial sequence
  Synthetic oligonucleotide
aaagcatcggcatcctgctggccat

SEQ ID NO: 723487 - DNA, 25 bp, Artificial sequence
  Synthetic oligonucleotide
ttcggcctgttcggcctgggcctgt

SEQ ID NO: 723488 - DNA, 25 bp, Artificial sequence
  Synthetic oligonucleotide
cggcgctgcataaaagcatcggcat

SEQ ID NO: 723489 - DNA, 25 bp, Artificial sequence
  Synthetic oligonucleotide
tgctggtgcggatcgtctggcgttt

SEQ ID NO: 723490 - DNA, 25 bp, Artificial sequence
  Synthetic oligonucleotide
accaccccgcgccggcgctgcataa

SEQ ID NO: 723491 - DNA, 25 bp, Artificial sequence
  Synthetic oligonucleotide
cctggtaccaccccgcgccggcgct

SEQ ID NO: 723492 - DNA, 25 bp, Artificial sequence
  Synthetic oligonucleotide
tgagctattacgacccctggtacca

SEQ ID NO: 723493 - DNA, 25 bp, Artificial sequence
  Synthetic oligonucleotide
gcgaactgagctattacgacccctg

SEQ ID NO: 723494 - DNA, 25 bp, Artificial sequence
  Synthetic oligonucleotide
ggatgcgcgaactgagctattacga

SEQ ID NO: 723495 - DNA, 25 bp, Artificial sequence
  Synthetic oligonucleotide
gcctgtggatgcgcgaactgagcta

SEQ ID NO: 723496 - DNA, 25 bp, Artificial sequence
  Synthetic oligonucleotide
tgcataaaagcatcggcatcctgct

SEQ ID NO: 723497 - DNA, 25 bp, Artificial sequence
  Synthetic oligonucleotide
actgttcaccgccggccaggcaatg

SEQ ID NO: 723498 - DNA, 25 bp, Artificial sequence
  Synthetic oligonucleotide
tccatgctgaagaagacccttgccg

SEQ ID NO: 723499 - DNA, 25 bp, Artificial sequence
  Synthetic oligonucleotide
acaagatcgacaaggaaggccagca

SEQ ID NO: 723500 - DNA, 25 bp, Artificial sequence
  Synthetic oligonucleotide
cggactacaagatcgacaaggaagg

SEQ ID NO: 723501 - DNA, 25 bp, Artificial sequence
  Synthetic oligonucleotide
tggccgcggactacaagatcgacaa

SEQ ID NO: 723502 - DNA, 25 bp, Artificial sequence
  Synthetic oligonucleotide
aggcaatggccgcggactacaagat

SEQ ID NO: 723503 - DNA, 25 bp, Artificial sequence
  Synthetic oligonucleotide
aggaaggccagcacgccttcatcga

SEQ ID NO: 723504 - DNA, 25 bp, Artificial sequence
  Synthetic oligonucleotide
caccgccggccaggcaatggccgcg

SEQ ID NO: 723505 - DNA, 25 bp, Artificial sequence
  Synthetic oligonucleotide
gccagcacgccttcatcgagttccg

SEQ ID NO: 723506 - DNA, 25 bp, Artificial sequence
  Synthetic oligonucleotide
gctccgcactgttcaccgccggcca

SEQ ID NO: 723507 - DNA, 25 bp, Artificial sequence
  Synthetic oligonucleotide
cgctcggctccgcactgttcaccgc

SEQ ID NO: 723508 - DNA, 25 bp, Artificial sequence
  Synthetic oligonucleotide
gcgctggcgctcggctccgcactgt

SEQ ID NO: 723509 - DNA, 25 bp, Artificial sequence
  Synthetic oligonucleotide
cttgccgcgctggcgctcggctccg

SEQ ID NO: 723510 - DNA, 25 bp, Artificial sequence
  Synthetic oligonucleotide
aagacccttgccgcgctggcgctcg

SEQ ID NO: 723511 - DNA, 25 bp, Artificial sequence
  Synthetic oligonucleotide
tccgtgccggcaaccctcagcgggc

SEQ ID NO: 723512 - DNA, 25 bp, Artificial sequence
  Synthetic oligonucleotide
ccggccaggcaatggccgcggacta

SEQ ID NO: 723513 - DNA, 25 bp, Artificial sequence
  Synthetic oligonucleotide
tagctggctgtacggccgcttcaac

SEQ ID NO: 723514 - DNA, 25 bp, Artificial sequence
  Synthetic oligonucleotide
acggcgtattcagcctgttcctgca

SEQ ID NO: 723515 - DNA, 25 bp, Artificial sequence
  Synthetic oligonucleotide
gcagcttcaccttcgacgagaagaa

SEQ ID NO: 723516 - DNA, 25 bp, Artificial sequence
  Synthetic oligonucleotide
tcgacggcagcttcaccttcgacga

SEQ ID NO: 723517 - DNA, 25 bp, Artificial sequence
  Synthetic oligonucleotide
acgacttcgacggcagcttcacctt

SEQ ID NO: 723518 - DNA, 25 bp, Artificial sequence
  Synthetic oligonucleotide
gcttcaacgacttcgacggcagctt

SEQ ID NO: 723519 - DNA, 25 bp, Artificial sequence
  Synthetic oligonucleotide
tcgacaaggaaggccagcacgcctt

SEQ ID NO: 723520 - DNA, 25 bp, Artificial sequence
  Synthetic oligonucleotide
gctgtacggccgcttcaacgacttc

SEQ ID NO: 723521 - DNA, 25 bp, Artificial sequence
  Synthetic oligonucleotide
agaatgtccatgctgaagaagaccc

SEQ ID NO: 723522 - DNA, 25 bp, Artificial sequence
  Synthetic oligonucleotide
ggctatagctggctgtacggccgct

SEQ ID NO: 723523 - DNA, 25 bp, Artificial sequence
  Synthetic oligonucleotide
gcacctgggctatagctggctgtac

SEQ ID NO: 723524 - DNA, 25 bp, Artificial sequence
  Synthetic oligonucleotide
catcaagcacctgggctatagctgg

SEQ ID NO: 723525 - DNA, 25 bp, Artificial sequence
  Synthetic oligonucleotide
gttccgcatcaagcacctgggctat

SEQ ID NO: 723526 - DNA, 25 bp, Artificial sequence
  Synthetic oligonucleotide
catcgagttccgcatcaagcacctg

SEQ ID NO: 723527 - DNA, 25 bp, Artificial sequence
  Synthetic oligonucleotide
acgccttcatcgagttccgcatcaa

SEQ ID NO: 723528 - DNA, 25 bp, Artificial sequence
  Synthetic oligonucleotide
acggccgcttcaacgacttcgacgg

SEQ ID NO: 723529 - DNA, 25 bp, Artificial sequence
  Synthetic oligonucleotide
gtgaaatccatctctacctggcctg

SEQ ID NO: 723530 - DNA, 25 bp, Artificial sequence
  Synthetic oligonucleotide
ctgaagaagacccttgccgcgctgg

SEQ ID NO: 723531 - DNA, 25 bp, Artificial sequence
  Synthetic oligonucleotide
ggtcttcgccgtcctccatgccctg

SEQ ID NO: 723532 - DNA, 25 bp, Artificial sequence
  Synthetic oligonucleotide
gctggtggtcttcgccgtcctccat

SEQ ID NO: 723533 - DNA, 25 bp, Artificial sequence
  Synthetic oligonucleotide
tgggcgctggtggtcttcgccgtcc

SEQ ID NO: 723534 - DNA, 25 bp, Artificial sequence
  Synthetic oligonucleotide
ctggcctgggcgctggtggtcttcg

SEQ ID NO: 723535 - DNA, 25 bp, Artificial sequence
  Synthetic oligonucleotide
cctccatgccctggccgccctcaag

SEQ ID NO: 723536 - DNA, 25 bp, Artificial sequence
  Synthetic oligonucleotide
atccatctctacctggcctgggcgc

SEQ ID NO: 723537 - DNA, 25 bp, Artificial sequence
  Synthetic oligonucleotide
tgccctggccgccctcaagcatcac

SEQ ID NO: 723538 - DNA, 25 bp, Artificial sequence
  Synthetic oligonucleotide
tcgcgggtgaaatccatctctacct

SEQ ID NO: 723539 - DNA, 25 bp, Artificial sequence
  Synthetic oligonucleotide
cagacgtcgcgggtgaaatccatct

SEQ ID NO: 723540 - DNA, 25 bp, Artificial sequence
  Synthetic oligonucleotide
accaggcagacgtcgcgggtgaaat

SEQ ID NO: 723541 - DNA, 25 bp, Artificial sequence
  Synthetic oligonucleotide
tgcccgaccaggcagacgtcgcggg

SEQ ID NO: 723542 - DNA, 25 bp, Artificial sequence
  Synthetic oligonucleotide
gcgggctgcccgaccaggcagacgt

SEQ ID NO: 723543 - DNA, 25 bp, Artificial sequence
  Synthetic oligonucleotide
tcgacgagaagaacccgtcggccga

SEQ ID NO: 723544 - DNA, 25 bp, Artificial sequence
  Synthetic oligonucleotide
ctctacctggcctgggcgctggtgg

SEQ ID NO: 723545 - DNA, 25 bp, Artificial sequence
  Synthetic oligonucleotide
aaagcgcatgctcggtcgctcgtcg

SEQ ID NO: 723546 - DNA, 25 bp, Artificial sequence
  Synthetic oligonucleotide
ttaaggagaatgtccatgctgaaga

SEQ ID NO: 723547 - DNA, 25 bp, Artificial sequence
  Synthetic oligonucleotide
accacgttaaggagaatgtccatgc

SEQ ID NO: 723548 - DNA, 25 bp, Artificial sequence
  Synthetic oligonucleotide
tcaacaaccacgttaaggagaatgt

SEQ ID NO: 723549 - DNA, 25 bp, Artificial sequence
  Synthetic oligonucleotide
gaatgatcaacaaccacgttaagga

SEQ ID NO: 723550 - DNA, 25 bp, Artificial sequence
  Synthetic oligonucleotide
ctcgtcgaatgatcaacaaccacgt

SEQ ID NO: 723551 - DNA, 25 bp, Artificial sequence
  Synthetic oligonucleotide
cgccgtcctccatgccctggccgcc

SEQ ID NO: 723552 - DNA, 25 bp, Artificial sequence
  Synthetic oligonucleotide
catgctcggtcgctcgtcgaatgat

SEQ ID NO: 723553 - DNA, 25 bp, Artificial sequence
  Synthetic oligonucleotide
cggcaaccctcagcgggctgcccga

SEQ ID NO: 723554 - DNA, 25 bp, Artificial sequence
  Synthetic oligonucleotide
accctaaagcgcatgctcggtcgct

SEQ ID NO: 723555 - DNA, 25 bp, Artificial sequence
  Synthetic oligonucleotide
gacccgaccctaaagcgcatgctcg

SEQ ID NO: 723556 - DNA, 25 bp, Artificial sequence
  Synthetic oligonucleotide
gaccgcgacccgaccctaaagcgca

SEQ ID NO: 723557 - DNA, 25 bp, Artificial sequence
  Synthetic oligonucleotide
gcatcacttcgtcgaccgcgacccg

SEQ ID NO: 723558 - DNA, 25 bp, Artificial sequence
  Synthetic oligonucleotide
cctcaagcatcacttcgtcgaccgc

SEQ ID NO: 723559 - DNA, 25 bp, Artificial sequence
  Synthetic oligonucleotide
ggccgccctcaagcatcacttcgtc

SEQ ID NO: 723560 - DNA, 25 bp, Artificial sequence
  Synthetic oligonucleotide
cggtcgctcgtcgaatgatcaacaa

SEQ ID NO: 723561 - DNA, 25 bp, Artificial sequence
  Synthetic oligonucleotide
tggaggacggtagccaatacccgct

SEQ ID NO: 723562 - DNA, 25 bp, Artificial sequence
  Synthetic oligonucleotide
cgtccaccgccctgctgcgcctgcg

SEQ ID NO: 723563 - DNA, 25 bp, Artificial sequence
  Synthetic oligonucleotide
ccgccctgctgcgcctgcgccgcga

SEQ ID NO: 723564 - DNA, 25 bp, Artificial sequence
  Synthetic oligonucleotide
tgctgcgcctgcgccgcgaactggc

SEQ ID NO: 723565 - DNA, 25 bp, Artificial sequence
  Synthetic oligonucleotide
cgcctgcgccgcgaactggccagcg

SEQ ID NO: 723566 - DNA, 25 bp, Artificial sequence
  Synthetic oligonucleotide
cgccgcgaactggccagcggccagt

SEQ ID NO: 723567 - DNA, 25 bp, Artificial sequence
  Synthetic oligonucleotide
gaactggccagcggccagttggagc

SEQ ID NO: 723568 - DNA, 25 bp, Artificial sequence
  Synthetic oligonucleotide
gccagcggccagttggagcgcgccg

SEQ ID NO: 723569 - DNA, 25 bp, Artificial sequence
  Synthetic oligonucleotide
gccagttggagcgcgccggcgacaa

SEQ ID NO: 723570 - DNA, 25 bp, Artificial sequence
  Synthetic oligonucleotide
ttggagcgcgccggcgacaacgcgg

SEQ ID NO: 723571 - DNA, 25 bp, Artificial sequence
  Synthetic oligonucleotide
cgcgccggcgacaacgcggcgaagg

SEQ ID NO: 723572 - DNA, 25 bp, Artificial sequence
  Synthetic oligonucleotide
ggcgacaacgcggcgaaggtctccc

SEQ ID NO: 723573 - DNA, 25 bp, Artificial sequence
  Synthetic oligonucleotide
aacgcggcgaaggtctccctgaagc

SEQ ID NO: 723574 - DNA, 25 bp, Artificial sequence
  Synthetic oligonucleotide
cgaaggtctccctgaagctggagga

SEQ ID NO: 723575 - DNA, 25 bp, Artificial sequence
  Synthetic oligonucleotide
ttccccaacccgaacaacgagctgc

SEQ ID NO: 723576 - DNA, 25 bp, Artificial sequence
  Synthetic oligonucleotide
tcgaattctccgaggtttccgtcga

SEQ ID NO: 723577 - DNA, 25 bp, Artificial sequence
  Synthetic oligonucleotide
cgccaatgccgcctacctgcagtcc

SEQ ID NO: 723578 - DNA, 25 bp, Artificial sequence
  Synthetic oligonucleotide
cggtcaccatccgcgccgtgttccc

SEQ ID NO: 723579 - DNA, 25 bp, Artificial sequence
  Synthetic oligonucleotide
ccggctcggtcaccatccgcgccgt

SEQ ID NO: 723580 - DNA, 25 bp, Artificial sequence
  Synthetic oligonucleotide
aaggcaccggctcggtcaccatccg

SEQ ID NO: 723581 - DNA, 25 bp, Artificial sequence
  Synthetic oligonucleotide
tcgacgaaggcaccggctcggtcac

SEQ ID NO: 723582 - DNA, 25 bp, Artificial sequence
  Synthetic oligonucleotide
ctccctgaagctggaggacggtagc

SEQ ID NO: 723583 - DNA, 25 bp, Artificial sequence
  Synthetic oligonucleotide
tccgaggtttccgtcgacgaaggca

SEQ ID NO: 723584 - DNA, 25 bp, Artificial sequence
  Synthetic oligonucleotide
gaagctggaggacggtagccaatac

SEQ ID NO: 723585 - DNA, 25 bp, Artificial sequence
  Synthetic oligonucleotide
gtcgcctcgaattctccgaggtttc

SEQ ID NO: 723586 - DNA, 25 bp, Artificial sequence
  Synthetic oligonucleotide
tggaaggtcgcctcgaattctccga

SEQ ID NO: 723587 - DNA, 25 bp, Artificial sequence
  Synthetic oligonucleotide
acccgctggaaggtcgcctcgaatt

SEQ ID NO: 723588 - DNA, 25 bp, Artificial sequence
  Synthetic oligonucleotide
gccaatacccgctggaaggtcgcct

SEQ ID NO: 723589 - DNA, 25 bp, Artificial sequence
  Synthetic oligonucleotide
acggtagccaatacccgctggaagg

SEQ ID NO: 723590 - DNA, 25 bp, Artificial sequence
  Synthetic oligonucleotide
acgtcgacgtcacccagccgtccac

SEQ ID NO: 723591 - DNA, 25 bp, Artificial sequence
  Synthetic oligonucleotide
tttccgtcgacgaaggcaccggctc

SEQ ID NO: 723592 - DNA, 25 bp, Artificial sequence
  Synthetic oligonucleotide
gcgcggatcaacctgcgctacacca

SEQ ID NO: 723593 - DNA, 25 bp, Artificial sequence
  Synthetic oligonucleotide
cccagccgtccaccgccctgctgcg

SEQ ID NO: 723594 - DNA, 25 bp, Artificial sequence
  Synthetic oligonucleotide
ccgatctccggccgcatcggccgtt

SEQ ID NO: 723595 - DNA, 25 bp, Artificial sequence
  Synthetic oligonucleotide
ctgtcgccgatctccggccgcatcg

SEQ ID NO: 723596 - DNA, 25 bp, Artificial sequence
  Synthetic oligonucleotide
aaggtgctgtcgccgatctccggcc

SEQ ID NO: 723597 - DNA, 25 bp, Artificial sequence
  Synthetic oligonucleotide
tacaccaaggtgctgtcgccgatct

SEQ ID NO: 723598 - DNA, 25 bp, Artificial sequence
  Synthetic oligonucleotide
ccgcatcggccgttccgcggtgacc

SEQ ID NO: 723599 - DNA, 25 bp, Artificial sequence
  Synthetic oligonucleotide
atcaacctgcgctacaccaaggtgc

SEQ ID NO: 723600 - DNA, 25 bp, Artificial sequence
  Synthetic oligonucleotide
gccgttccgcggtgaccgaaggcgc

SEQ ID NO: 723601 - DNA, 25 bp, Artificial sequence
  Synthetic oligonucleotide
gagcaggcgcggatcaacctgcgct

SEQ ID NO: 723602 - DNA, 25 bp, Artificial sequence
  Synthetic oligonucleotide
ggcggtggagcaggcgcggatcaac

SEQ ID NO: 723603 - DNA, 25 bp, Artificial sequence
  Synthetic oligonucleotide
caaggcggcggtggagcaggcgcgg

SEQ ID NO: 723604 - DNA, 25 bp, Artificial sequence
  Synthetic oligonucleotide
gcagtccaaggcggcggtggagcag

SEQ ID NO: 723605 - DNA, 25 bp, Artificial sequence
  Synthetic oligonucleotide
ctacctgcagtccaaggcggcggtg

SEQ ID NO: 723606 - DNA, 25 bp, Artificial sequence
  Synthetic oligonucleotide
tgccgcctacctgcagtccaaggcg

SEQ ID NO: 723607 - DNA, 25 bp, Artificial sequence
  Synthetic oligonucleotide
ctgcgctacaccaaggtgctgtcgc

SEQ ID NO: 723608 - DNA, 25 bp, Artificial sequence
  Synthetic oligonucleotide
aggccaacgcgatggccaccgtgca

SEQ ID NO: 723609 - DNA, 25 bp, Artificial sequence
  Synthetic oligonucleotide
aacccgaacaacgagctgctgcccg

SEQ ID NO: 723610 - DNA, 25 bp, Artificial sequence
  Synthetic oligonucleotide
cgatctacgtcgacgtcacccagcc

SEQ ID NO: 723611 - DNA, 25 bp, Artificial sequence
  Synthetic oligonucleotide
tcgacccgatctacgtcgacgtcac

SEQ ID NO: 723612 - DNA, 25 bp, Artificial sequence
  Synthetic oligonucleotide
aacagctcgacccgatctacgtcga

SEQ ID NO: 723613 - DNA, 25 bp, Artificial sequence
  Synthetic oligonucleotide
ccgtgcaacagctcgacccgatcta

SEQ ID NO: 723614 - DNA, 25 bp, Artificial sequence
  Synthetic oligonucleotide
ctccggccgcatcggccgttccgcg

SEQ ID NO: 723615 - DNA, 25 bp, Artificial sequence
  Synthetic oligonucleotide
acgcgatggccaccgtgcaacagct

SEQ ID NO: 723616 - DNA, 25 bp, Artificial sequence
  Synthetic oligonucleotide
acgtcacccagccgtccaccgccct

SEQ ID NO: 723617 - DNA, 25 bp, Artificial sequence
  Synthetic oligonucleotide
aacggccaggccaacgcgatggcca

SEQ ID NO: 723618 - DNA, 25 bp, Artificial sequence
  Synthetic oligonucleotide
tgaccaacggccaggccaacgcgat

SEQ ID NO: 723619 - DNA, 25 bp, Artificial sequence
  Synthetic oligonucleotide
ccctggtgaccaacggccaggccaa

SEQ ID NO: 723620 - DNA, 25 bp, Artificial sequence
  Synthetic oligonucleotide
aaggcgccctggtgaccaacggcca

SEQ ID NO: 723621 - DNA, 25 bp, Artificial sequence
  Synthetic oligonucleotide
tgaccgaaggcgccctggtgaccaa

SEQ ID NO: 723622 - DNA, 25 bp, Artificial sequence
  Synthetic oligonucleotide
ccgcggtgaccgaaggcgccctggt

SEQ ID NO: 723623 - DNA, 25 bp, Artificial sequence
  Synthetic oligonucleotide
tggccaccgtgcaacagctcgaccc

SEQ ID NO: 723624 - DNA, 25 bp, Artificial sequence
  Synthetic oligonucleotide
gtccgcgcagaaggccgacgccgct

SEQ ID NO: 723625 - DNA, 25 bp, Artificial sequence
  Synthetic oligonucleotide
tgaacgccggcgacaagatcattac

SEQ ID NO: 723626 - DNA, 25 bp, Artificial sequence
  Synthetic oligonucleotide
ccggcgacaagatcattaccgaagg

SEQ ID NO: 723627 - DNA, 25 bp, Artificial sequence
  Synthetic oligonucleotide
acaagatcattaccgaaggcctgca

SEQ ID NO: 723628 - DNA, 25 bp, Artificial sequence
  Synthetic oligonucleotide
tcattaccgaaggcctgcagttcgt

SEQ ID NO: 723629 - DNA, 25 bp, Artificial sequence
  Synthetic oligonucleotide
ccgaaggcctgcagttcgtgcagcc

SEQ ID NO: 723630 - DNA, 25 bp, Artificial sequence
  Synthetic oligonucleotide
cctgcagttcgtgcagccgggtgtc

SEQ ID NO: 723631 - DNA, 25 bp, Artificial sequence
  Synthetic oligonucleotide
gttcgtgcagccgggtgtcgaggtg

SEQ ID NO: 723632 - DNA, 25 bp, Artificial sequence
  Synthetic oligonucleotide
gcagccgggtgtcgaggtgaagacc

SEQ ID NO: 723633 - DNA, 25 bp, Artificial sequence
  Synthetic oligonucleotide
gggtgtcgaggtgaagaccgtgccg

SEQ ID NO: 723634 - DNA, 25 bp, Artificial sequence
  Synthetic oligonucleotide
tcgaggtgaagaccgtgccggcgaa

SEQ ID NO: 723635 - DNA, 25 bp, Artificial sequence
  Synthetic oligonucleotide
tgaagaccgtgccggcgaagaatgt

SEQ ID NO: 723636 - DNA, 25 bp, Artificial sequence
  Synthetic oligonucleotide
ccgtgccggcgaagaatgtcgcgtc

SEQ ID NO: 723637 - DNA, 25 bp, Artificial sequence
  Synthetic oligonucleotide
cggcgaagaatgtcgcgtccgcgca

SEQ ID NO: 723638 - DNA, 25 bp, Artificial sequence
  Synthetic oligonucleotide
catccgcgccgtgttccccaacccg

SEQ ID NO: 723639 - DNA, 25 bp, Artificial sequence
  Synthetic oligonucleotide
cagcaagggctgatcaaggggattc

SEQ ID NO: 723640 - DNA, 25 bp, Artificial sequence
  Synthetic oligonucleotide
ctcatcccgttacggcgtattcagc

SEQ ID NO: 723641 - DNA, 25 bp, Artificial sequence
  Synthetic oligonucleotide
cgagtcgctggcaatcgagctcgct

SEQ ID NO: 723642 - DNA, 25 bp, Artificial sequence
  Synthetic oligonucleotide
tttttcattgataggcccattttcg

SEQ ID NO: 723643 - DNA, 25 bp, Artificial sequence
  Synthetic oligonucleotide
gtaatgtcgaagtttttcattgata

SEQ ID NO: 723644 - DNA, 25 bp, Artificial sequence
  Synthetic oligonucleotide
ggattcgtaatgtcgaagtttttca

SEQ ID NO: 723645 - DNA, 25 bp, Artificial sequence
  Synthetic oligonucleotide
aagaatgtcgcgtccgcgcagaagg

SEQ ID NO: 723646 - DNA, 25 bp, Artificial sequence
  Synthetic oligonucleotide
agggctgatcaaggggattcgtaat

SEQ ID NO: 723647 - DNA, 25 bp, Artificial sequence
  Synthetic oligonucleotide
gtcgcgtccgcgcagaaggccgacg

SEQ ID NO: 723648 - DNA, 25 bp, Artificial sequence
  Synthetic oligonucleotide
aaccgacagcaagggctgatcaagg

SEQ ID NO: 723649 - DNA, 25 bp, Artificial sequence
  Synthetic oligonucleotide
gcgaaaaccgacagcaagggctgat

SEQ ID NO: 723650 - DNA, 25 bp, Artificial sequence
  Synthetic oligonucleotide
gctccggcgaaaaccgacagcaagg

SEQ ID NO: 723651 - DNA, 25 bp, Artificial sequence
  Synthetic oligonucleotide
gacgccgctccggcgaaaaccgaca

SEQ ID NO: 723652 - DNA, 25 bp, Artificial sequence
  Synthetic oligonucleotide
gcagaaggccgacgccgctccggcg

SEQ ID NO: 723653 - DNA, 25 bp, Artificial sequence
  Synthetic oligonucleotide
tggctggttaccgaaggcctgaacg

SEQ ID NO: 723654 - DNA, 25 bp, Artificial sequence
  Synthetic oligonucleotide
gatcaaggggattcgtaatgtcgaa

SEQ ID NO: 723655 - DNA, 25 bp, Artificial sequence
  Synthetic oligonucleotide
cagttgcaggaaggcgtcaagcaga

SEQ ID NO: 723656 - DNA, 25 bp, Artificial sequence
  Synthetic oligonucleotide
aaggcctgaacgccggcgacaagat

SEQ ID NO: 723657 - DNA, 25 bp, Artificial sequence
  Synthetic oligonucleotide
caaggcgtgacccgcgacctcaagg

SEQ ID NO: 723658 - DNA, 25 bp, Artificial sequence
  Synthetic oligonucleotide
ccgcagcaaggcgtgacccgcgacc

SEQ ID NO: 723659 - DNA, 25 bp, Artificial sequence
  Synthetic oligonucleotide
cctcgctccgcagcaaggcgtgacc

SEQ ID NO: 723660 - DNA, 25 bp, Artificial sequence
  Synthetic oligonucleotide
ggccatcctcgctccgcagcaaggc

SEQ ID NO: 723661 - DNA, 25 bp, Artificial sequence
  Synthetic oligonucleotide
cgcgacctcaagggccaggctaccg

SEQ ID NO: 723662 - DNA, 25 bp, Artificial sequence
  Synthetic oligonucleotide
caggaaggcgtcaagcagaaggcca

SEQ ID NO: 723663 - DNA, 25 bp, Artificial sequence
  Synthetic oligonucleotide
tcaagggccaggctaccgcgctggt

SEQ ID NO: 723664 - DNA, 25 bp, Artificial sequence
  Synthetic oligonucleotide
acgcgcagttgcaggaaggcgtcaa

SEQ ID NO: 723665 - DNA, 25 bp, Artificial sequence
  Synthetic oligonucleotide
tcgttcacgcgcagttgcaggaagg

SEQ ID NO: 723666 - DNA, 25 bp, Artificial sequence
  Synthetic oligonucleotide
gcatgttcgttcacgcgcagttgca

SEQ ID NO: 723667 - DNA, 25 bp, Artificial sequence
  Synthetic oligonucleotide
tgcccggcatgttcgttcacgcgca

SEQ ID NO: 723668 - DNA, 25 bp, Artificial sequence
  Synthetic oligonucleotide
gagctgctgcccggcatgttcgttc

SEQ ID NO: 723669 - DNA, 25 bp, Artificial sequence
  Synthetic oligonucleotide
aacaacgagctgctgcccggcatgt

SEQ ID NO: 723670 - DNA, 25 bp, Artificial sequence
  Synthetic oligonucleotide
gcagaaggccatcctcgctccgcag

SEQ ID NO: 723671 - DNA, 25 bp, Artificial sequence
  Synthetic oligonucleotide
aggtcgagctgcgggtgatcaaggc

SEQ ID NO: 723672 - DNA, 25 bp, Artificial sequence
  Synthetic oligonucleotide
tcgaagtttttcattgataggccca

SEQ ID NO: 723673 - DNA, 25 bp, Artificial sequence
  Synthetic oligonucleotide
cgacaagtggctggttaccgaaggc

SEQ ID NO: 723674 - DNA, 25 bp, Artificial sequence
  Synthetic oligonucleotide
tgatcggcgacaagtggctggttac

SEQ ID NO: 723675 - DNA, 25 bp, Artificial sequence
  Synthetic oligonucleotide
gaccgggtgatcggcgacaagtggc

SEQ ID NO: 723676 - DNA, 25 bp, Artificial sequence
  Synthetic oligonucleotide
aaggccgaccgggtgatcggcgaca

SEQ ID NO: 723677 - DNA, 25 bp, Artificial sequence
  Synthetic oligonucleotide
gtgacccgcgacctcaagggccagg

SEQ ID NO: 723678 - DNA, 25 bp, Artificial sequence
  Synthetic oligonucleotide
gctgcgggtgatcaaggccgaccgg

SEQ ID NO: 723679 - DNA, 25 bp, Artificial sequence
  Synthetic oligonucleotide
ttaccgaaggcctgaacgccggcga

SEQ ID NO: 723680 - DNA, 25 bp, Artificial sequence
  Synthetic oligonucleotide
agaacaaggtcgagctgcgggtgat

SEQ ID NO: 723681 - DNA, 25 bp, Artificial sequence
  Synthetic oligonucleotide
acgcgcagaacaaggtcgagctgcg

SEQ ID NO: 723682 - DNA, 25 bp, Artificial sequence
  Synthetic oligonucleotide
tggtgaacgcgcagaacaaggtcga

SEQ ID NO: 723683 - DNA, 25 bp, Artificial sequence
  Synthetic oligonucleotide
cgctggtggtgaacgcgcagaacaa

SEQ ID NO: 723684 - DNA, 25 bp, Artificial sequence
  Synthetic oligonucleotide
ctaccgcgctggtggtgaacgcgca

SEQ ID NO: 723685 - DNA, 25 bp, Artificial sequence
  Synthetic oligonucleotide
gccaggctaccgcgctggtggtgaa

SEQ ID NO: 723686 - DNA, 25 bp, Artificial sequence
  Synthetic oligonucleotide
ggtgatcaaggccgaccgggtgatc

SEQ ID NO: 723687 - DNA, 25 bp, Artificial sequence
  Synthetic oligonucleotide
agtattttgcctgccttcttcgagc

SEQ ID NO: 723688 - DNA, 25 bp, Artificial sequence
  Synthetic oligonucleotide
tgggccatggcgccgggtggataac

SEQ ID NO: 723689 - DNA, 25 bp, Artificial sequence
  Synthetic oligonucleotide
agctcgctctggatgcgcgtccgca

SEQ ID NO: 723690 - DNA, 25 bp, Artificial sequence
  Synthetic oligonucleotide
ccgggtggataaccggccatcgagc

SEQ ID NO: 723691 - DNA, 25 bp, Artificial sequence
  Synthetic oligonucleotide
ggataaccggccatcgagctaaaac

SEQ ID NO: 723692 - DNA, 25 bp, Artificial sequence
  Synthetic oligonucleotide
ccggccatcgagctaaaacgtttca

SEQ ID NO: 723693 - DNA, 25 bp, Artificial sequence
  Synthetic oligonucleotide
atcgagctaaaacgtttcaggtgtt

SEQ ID NO: 723694 - DNA, 25 bp, Artificial sequence
  Synthetic oligonucleotide
aacgtttcaggtgttttcacgcgag

SEQ ID NO: 723695 - DNA, 25 bp, Artificial sequence
  Synthetic oligonucleotide
tcaggtgttttcacgcgaggctttc

SEQ ID NO: 723696 - DNA, 25 bp, Artificial sequence
  Synthetic oligonucleotide
tgttttcacgcgaggctttcggacg

SEQ ID NO: 723697 - DNA, 25 bp, Artificial sequence
  Synthetic oligonucleotide
cacgcgaggctttcggacgtttaca

SEQ ID NO: 723698 - DNA, 25 bp, Artificial sequence
  Synthetic oligonucleotide
ttcggacgtttacaaacacctatga

SEQ ID NO: 723699 - DNA, 25 bp, Artificial sequence
  Synthetic oligonucleotide
cgtttacaaacacctatgaatgtaa

SEQ ID NO: 723700 - DNA, 25 bp, Artificial sequence
  Synthetic oligonucleotide
caaacacctatgaatgtaagtattt

SEQ ID NO: 723701 - DNA, 25 bp, Artificial sequence
  Synthetic oligonucleotide
aacgaacgccagccatgcgtgtact

SEQ ID NO: 723702 - DNA, 25 bp, Artificial sequence
  Synthetic oligonucleotide
ccttcacgctgcatcggccgctttc

SEQ ID NO: 723703 - DNA, 25 bp, Artificial sequence
  Synthetic oligonucleotide
ctatgcaacgaacgccagccatgcg

SEQ ID NO: 723704 - DNA, 25 bp, Artificial sequence
  Synthetic oligonucleotide
acaacgctatgcaacgaacgccagc

SEQ ID NO: 723705 - DNA, 25 bp, Artificial sequence
  Synthetic oligonucleotide
tgaggacaacgctatgcaacgaacg

SEQ ID NO: 723706 - DNA, 25 bp, Artificial sequence
  Synthetic oligonucleotide
cgctcatgaggacaacgctatgcaa

SEQ ID NO: 723707 - DNA, 25 bp, Artificial sequence
  Synthetic oligonucleotide
cgctttcgctcatgaggacaacgct

SEQ ID NO: 723708 - DNA, 25 bp, Artificial sequence
  Synthetic oligonucleotide
cctatgaatgtaagtattttgcctg

SEQ ID NO: 723709 - DNA, 25 bp, Artificial sequence
  Synthetic oligonucleotide
cgctgcatcggccgctttcgctcat

SEQ ID NO: 723710 - DNA, 25 bp, Artificial sequence
  Synthetic oligonucleotide
aatgtaagtattttgcctgccttct

SEQ ID NO: 723711 - DNA, 25 bp, Artificial sequence
  Synthetic oligonucleotide
gcagcgccttcacgctgcatcggcc

SEQ ID NO: 723712 - DNA, 25 bp, Artificial sequence
  Synthetic oligonucleotide
agccggtgcagcgccttcacgctgc

SEQ ID NO: 723713 - DNA, 25 bp, Artificial sequence
  Synthetic oligonucleotide
tcttcgagccggtgcagcgccttca

SEQ ID NO: 723714 - DNA, 25 bp, Artificial sequence
  Synthetic oligonucleotide
tgccttcttcgagccggtgcagcgc

SEQ ID NO: 723715 - DNA, 25 bp, Artificial sequence
  Synthetic oligonucleotide
ttgcctgccttcttcgagccggtgc

SEQ ID NO: 723716 - DNA, 25 bp, Artificial sequence
  Synthetic oligonucleotide
gtttcaggttctgaatatgggccat

SEQ ID NO: 723717 - DNA, 25 bp, Artificial sequence
  Synthetic oligonucleotide
atcggccgctttcgctcatgaggac

SEQ ID NO: 723718 - DNA, 25 bp, Artificial sequence
  Synthetic oligonucleotide
catgctggaagaccgccatcagcgc

SEQ ID NO: 723719 - DNA, 25 bp, Artificial sequence
  Synthetic oligonucleotide
cgccgacgccaatgccgcctacctg

SEQ ID NO: 723720 - DNA, 25 bp, Artificial sequence
  Synthetic oligonucleotide
tcgggattcacggggtagttcattg

SEQ ID NO: 723721 - DNA, 25 bp, Artificial sequence
  Synthetic oligonucleotide
atcaggtcgggattcacggggtagt

SEQ ID NO: 723722 - DNA, 25 bp, Artificial sequence
  Synthetic oligonucleotide
gcgggcatcaggtcgggattcacgg

SEQ ID NO: 723723 - DNA, 25 bp, Artificial sequence
  Synthetic oligonucleotide
atcagcgcgggcatcaggtcgggat

SEQ ID NO: 723724 - DNA, 25 bp, Artificial sequence
  Synthetic oligonucleotide
ggtagttcattggtttggccgagta

SEQ ID NO: 723725 - DNA, 25 bp, Artificial sequence
  Synthetic oligonucleotide
ggaagaccgccatcagcgcgggcat

SEQ ID NO: 723726 - DNA, 25 bp, Artificial sequence
  Synthetic oligonucleotide
tcattggtttggccgagtaaaccta

SEQ ID NO: 723727 - DNA, 25 bp, Artificial sequence
  Synthetic oligonucleotide
tccgcacatgctggaagaccgccat

SEQ ID NO: 723728 - DNA, 25 bp, Artificial sequence
  Synthetic oligonucleotide
tgcgcgtccgcacatgctggaagac

SEQ ID NO: 723729 - DNA, 25 bp, Artificial sequence
  Synthetic oligonucleotide
tctggatgcgcgtccgcacatgctg

SEQ ID NO: 723730 - DNA, 25 bp, Artificial sequence
  Synthetic oligonucleotide
aatcgagctcgctctggatgcgcgt

SEQ ID NO: 723731 - DNA, 25 bp, Artificial sequence
  Synthetic oligonucleotide
gctggcaatcgagctcgctctggat

SEQ ID NO: 723732 - DNA, 25 bp, Artificial sequence
  Synthetic oligonucleotide
attgataggcccattttcgcgtggg

SEQ ID NO: 723733 - DNA, 25 bp, Artificial sequence
  Synthetic oligonucleotide
accgccatcagcgcgggcatcaggt

SEQ ID NO: 723734 - DNA, 25 bp, Artificial sequence
  Synthetic oligonucleotide
agtcaactattttgcttattttagt

SEQ ID NO: 723735 - DNA, 25 bp, Artificial sequence
  Synthetic oligonucleotide
atggcgccgggtggataaccggcca

SEQ ID NO: 723736 - DNA, 25 bp, Artificial sequence
  Synthetic oligonucleotide
aaccttgtttcaggttctgaatatg

SEQ ID NO: 723737 - DNA, 25 bp, Artificial sequence
  Synthetic oligonucleotide
cttatcaaccttgtttcaggttctg

SEQ ID NO: 723738 - DNA, 25 bp, Artificial sequence
  Synthetic oligonucleotide
gttgaccttatcaaccttgtttcag

SEQ ID NO: 723739 - DNA, 25 bp, Artificial sequence
  Synthetic oligonucleotide
attttagttgaccttatcaaccttg

SEQ ID NO: 723740 - DNA, 25 bp, Artificial sequence
  Synthetic oligonucleotide
tcacggggtagttcattggtttggc

SEQ ID NO: 723741 - DNA, 25 bp, Artificial sequence
  Synthetic oligonucleotide
ctattttgcttattttagttgacct

SEQ ID NO: 723742 - DNA, 25 bp, Artificial sequence
  Synthetic oligonucleotide
ggttctgaatatgggccatggcgcc

SEQ ID NO: 723743 - DNA, 25 bp, Artificial sequence
  Synthetic oligonucleotide
gatccagtcaactattttgcttatt

SEQ ID NO: 723744 - DNA, 25 bp, Artificial sequence
  Synthetic oligonucleotide
gtggttgatccagtcaactattttg

SEQ ID NO: 723745 - DNA, 25 bp, Artificial sequence
  Synthetic oligonucleotide
gtaaatgtggttgatccagtcaact

SEQ ID NO: 723746 - DNA, 25 bp, Artificial sequence
  Synthetic oligonucleotide
cctaatgtaaatgtggttgatccag

SEQ ID NO: 723747 - DNA, 25 bp, Artificial sequence
  Synthetic oligonucleotide
agtaaacctaatgtaaatgtggttg

SEQ ID NO: 723748 - DNA, 25 bp, Artificial sequence
  Synthetic oligonucleotide
tggccgagtaaacctaatgtaaatg

SEQ ID NO: 723749 - DNA, 25 bp, Artificial sequence
  Synthetic oligonucleotide
tgcttattttagttgaccttatcaa

SEQ ID NO: 723750 - DNA, 25 bp, Artificial sequence
  Synthetic oligonucleotide
tcaaggccgggcagcagctctacca

SEQ ID NO: 723751 - DNA, 25 bp, Artificial sequence
  Synthetic oligonucleotide
acggcatcatcctcaagcgcctgtt

SEQ ID NO: 723752 - DNA, 25 bp, Artificial sequence
  Synthetic oligonucleotide
ccgtgagcaagcagcagtacgccga

SEQ ID NO: 723753 - DNA, 25 bp, Artificial sequence
  Synthetic oligonucleotide
ccgccacctacgaggccgactacca

SEQ ID NO: 723754 - DNA, 25 bp, Artificial sequence
  Synthetic oligonucleotide
agatcgaccccgccacctacgaggc

SEQ ID NO: 723755 - DNA, 25 bp, Artificial sequence
  Synthetic oligonucleotide
tctaccagatcgaccccgccaccta

SEQ ID NO: 723756 - DNA, 25 bp, Artificial sequence
  Synthetic oligonucleotide
agagcgcccaggccaacctggcttc

SEQ ID NO: 723757 - DNA, 25 bp, Artificial sequence
  Synthetic oligonucleotide
ccgggcagcagctctaccagatcga

SEQ ID NO: 723758 - DNA, 25 bp, Artificial sequence
  Synthetic oligonucleotide
cccaggccaacctggcttcgaccca

SEQ ID NO: 723759 - DNA, 25 bp, Artificial sequence
  Synthetic oligonucleotide
gcgacgtcaaggccgggcagcagct

SEQ ID NO: 723760 - DNA, 25 bp, Artificial sequence
  Synthetic oligonucleotide
aaggcagcgacgtcaaggccgggca

SEQ ID NO: 723761 - DNA, 25 bp, Artificial sequence
  Synthetic oligonucleotide
tcaaggaaggcagcgacgtcaaggc

SEQ ID NO: 723762 - DNA, 25 bp, Artificial sequence
  Synthetic oligonucleotide
gcctgttcaaggaaggcagcgacgt

SEQ ID NO: 723763 - DNA, 25 bp, Artificial sequence
  Synthetic oligonucleotide
tcaagcgcctgttcaaggaaggcag

SEQ ID NO: 723764 - DNA, 25 bp, Artificial sequence
  Synthetic oligonucleotide
tcatcctcaagcgcctgttcaagga

SEQ ID NO: 723765 - DNA, 25 bp, Artificial sequence
  Synthetic oligonucleotide
agcagctctaccagatcgaccccgc

SEQ ID NO: 723766 - DNA, 25 bp, Artificial sequence
  Synthetic oligonucleotide
acaagctgctggtcgccgaccaggc

SEQ ID NO: 723767 - DNA, 25 bp, Artificial sequence
  Synthetic oligonucleotide
caagcagcagtacgccgacgccaat

SEQ ID NO: 723768 - DNA, 25 bp, Artificial sequence
  Synthetic oligonucleotide
gaatatgggccatggcgccgggtgg

SEQ ID NO: 723769 - DNA, 25 bp, Artificial sequence
  Synthetic oligonucleotide
gcagtacgccgacgccaatgccgcc

SEQ ID NO: 723770 - DNA, 25 bp, Artificial sequence
  Synthetic oligonucleotide
gccagccatgcgtgtactggttccg

SEQ ID NO: 723771 - DNA, 25 bp, Artificial sequence
  Synthetic oligonucleotide
accaggccgtgagcaagcagcagta

SEQ ID NO: 723772 - DNA, 25 bp, Artificial sequence
  Synthetic oligonucleotide
aggccgactaccagagcgcccaggc

SEQ ID NO: 723773 - DNA, 25 bp, Artificial sequence
  Synthetic oligonucleotide
tgctggtcgccgaccaggccgtgag

SEQ ID NO: 723774 - DNA, 25 bp, Artificial sequence
  Synthetic oligonucleotide
cctacgaggccgactaccagagcgc

SEQ ID NO: 723775 - DNA, 25 bp, Artificial sequence
  Synthetic oligonucleotide
agcgctacaagctgctggtcgccga

SEQ ID NO: 723776 - DNA, 25 bp, Artificial sequence
  Synthetic oligonucleotide
ggcccagcgctacaagctgctggtc

SEQ ID NO: 723777 - DNA, 25 bp, Artificial sequence
  Synthetic oligonucleotide
aggaacaggcccagcgctacaagct

SEQ ID NO: 723778 - DNA, 25 bp, Artificial sequence
  Synthetic oligonucleotide
cgacccaggaacaggcccagcgcta

SEQ ID NO: 723779 - DNA, 25 bp, Artificial sequence
  Synthetic oligonucleotide
tggcttcgacccaggaacaggccca

SEQ ID NO: 723780 - DNA, 25 bp, Artificial sequence
  Synthetic oligonucleotide
ccaacctggcttcgacccaggaaca

SEQ ID NO: 723781 - DNA, 25 bp, Artificial sequence
  Synthetic oligonucleotide
tcgccgaccaggccgtgagcaagca

SEQ ID NO: 723782 - DNA, 25 bp, Artificial sequence
  Synthetic oligonucleotide
tgcggaaaaagcgaggcgccgccgc

SEQ ID NO: 723783 - DNA, 25 bp, Artificial sequence
  Synthetic oligonucleotide
ggtcgggatcgtgaccctggaagcg

SEQ ID NO: 723784 - DNA, 25 bp, Artificial sequence
  Synthetic oligonucleotide
gccggaggtcgggatcgtgaccctg

SEQ ID NO: 723785 - DNA, 25 bp, Artificial sequence
  Synthetic oligonucleotide
caaacgccggaggtcgggatcgtga

SEQ ID NO: 723786 - DNA, 25 bp, Artificial sequence
  Synthetic oligonucleotide
cggcgcaaacgccggaggtcgggat

SEQ ID NO: 723787 - DNA, 25 bp, Artificial sequence
  Synthetic oligonucleotide
ccgccgccggcgcaaacgccggagg

SEQ ID NO: 723788 - DNA, 25 bp, Artificial sequence
  Synthetic oligonucleotide
gatcgtgaccctggaagcgcagacg

SEQ ID NO: 723789 - DNA, 25 bp, Artificial sequence
  Synthetic oligonucleotide
aaaagcgaggcgccgccgccggcgc

SEQ ID NO: 723790 - DNA, 25 bp, Artificial sequence
  Synthetic oligonucleotide
tggttccggccctgctggtcgcgat

SEQ ID NO: 723791 - DNA, 25 bp, Artificial sequence
  Synthetic oligonucleotide
tccgggtgcggaaaaagcgaggcgc

SEQ ID NO: 723792 - DNA, 25 bp, Artificial sequence
  Synthetic oligonucleotide
tgctggtcgcgatttcggccctttc

SEQ ID NO: 723793 - DNA, 25 bp, Artificial sequence
  Synthetic oligonucleotide
cggccctgctggtcgcgatttcggc

SEQ ID NO: 723794 - DNA, 25 bp, Artificial sequence
  Synthetic oligonucleotide
aggtgaacggcatcatcctcaagcg

SEQ ID NO: 723795 - DNA, 25 bp, Artificial sequence
  Synthetic oligonucleotide
gtgtactggttccggccctgctggt

SEQ ID NO: 723796 - DNA, 25 bp, Artificial sequence
  Synthetic oligonucleotide
actaccagagcgcccaggccaacct

SEQ ID NO: 723797 - DNA, 25 bp, Artificial sequence
  Synthetic oligonucleotide
gaggcgccgccgccggcgcaaacgc

SEQ ID NO: 723798 - DNA, 25 bp, Artificial sequence
  Synthetic oligonucleotide
cgccgaggtgcgtccccaggtgaac

SEQ ID NO: 723799 - DNA, 25 bp, Artificial sequence
  Synthetic oligonucleotide
ccatgcgtgtactggttccggccct

SEQ ID NO: 723800 - DNA, 25 bp, Artificial sequence
  Synthetic oligonucleotide
gaccctggaagcgcagacggtgacc

SEQ ID NO: 723801 - DNA, 25 bp, Artificial sequence
  Synthetic oligonucleotide
ggtgcgtccccaggtgaacggcatc

SEQ ID NO: 723802 - DNA, 25 bp, Artificial sequence
  Synthetic oligonucleotide
ccgcatcgccgaggtgcgtccccag

SEQ ID NO: 723803 - DNA, 25 bp, Artificial sequence
  Synthetic oligonucleotide
tgcgttccgcatcgccgaggtgcgt

SEQ ID NO: 723804 - DNA, 25 bp, Artificial sequence
  Synthetic oligonucleotide
gaccaatgcgttccgcatcgccgag

SEQ ID NO: 723805 - DNA, 25 bp, Artificial sequence
  Synthetic oligonucleotide
ggccggaccaatgcgttccgcatcg

SEQ ID NO: 723806 - DNA, 25 bp, Artificial sequence
  Synthetic oligonucleotide
ccgagctgccgggccggaccaatgc

SEQ ID NO: 723807 - DNA, 25 bp, Artificial sequence
  Synthetic oligonucleotide
ctgaataccgagctgccgggccgga

SEQ ID NO: 723808 - DNA, 25 bp, Artificial sequence
  Synthetic oligonucleotide
gtgaccctgaataccgagctgccgg

SEQ ID NO: 723809 - DNA, 25 bp, Artificial sequence
  Synthetic oligonucleotide
cagacggtgaccctgaataccgagc

SEQ ID NO: 723810 - DNA, 25 bp, Artificial sequence
  Synthetic oligonucleotide
tgccgggccggaccaatgcgttccg

SEQ ID NO: 723811 - DNA, 25 bp, Artificial sequence
  Synthetic oligonucleotide
gtccccaggtgaacggcatcatcct

SEQ ID NO: 723812 - DNA, 25 bp, Artificial sequence
  Synthetic oligonucleotide
gaagcgcagacggtgaccctgaata

SEQ ID NO: 723813 - DNA, 25 bp, Artificial sequence
  Synthetic oligonucleotide
cctggaaggcatgttccagcgctac

SEQ ID NO: 723814 - DNA, 25 bp, Artificial sequence
  Synthetic oligonucleotide
cgcaagtacttctccaagaccgtcg

SEQ ID NO: 723815 - DNA, 25 bp, Artificial sequence
  Synthetic oligonucleotide
gcggcgagctggatccgaaggtcaa

SEQ ID NO: 723816 - DNA, 25 bp, Artificial sequence
  Synthetic oligonucleotide
acgctcgcggcgagctggatccgaa

SEQ ID NO: 723817 - DNA, 25 bp, Artificial sequence
  Synthetic oligonucleotide
agcgctacgctcgcggcgagctgga

SEQ ID NO: 723818 - DNA, 25 bp, Artificial sequence
  Synthetic oligonucleotide
aaggcatgttccagcgctacgctcg

SEQ ID NO: 723819 - DNA, 25 bp, Artificial sequence
  Synthetic oligonucleotide
cgatctccctggaaggcatgttcca

SEQ ID NO: 723820 - DNA, 25 bp, Artificial sequence
  Synthetic oligonucleotide
atcaagccgatctccctggaaggca

SEQ ID NO: 723821 - DNA, 25 bp, Artificial sequence
  Synthetic oligonucleotide
tccaagatcaagccgatctccctgg

SEQ ID NO: 723822 - DNA, 25 bp, Artificial sequence
  Synthetic oligonucleotide
aacgcttccaagatcaagccgatct

SEQ ID NO: 723823 - DNA, 25 bp, Artificial sequence
  Synthetic oligonucleotide
gccggcaacgcttccaagatcaagc

SEQ ID NO: 723824 - DNA, 25 bp, Artificial sequence
  Synthetic oligonucleotide
gaggccatgcgcgacatctgcatcg

SEQ ID NO: 723825 - DNA, 25 bp, Artificial sequence
  Synthetic oligonucleotide
tgttccagcgctacgctcgcggcga

SEQ ID NO: 723826 - DNA, 25 bp, Artificial sequence
  Synthetic oligonucleotide
ggcaccgccggcaacgcttccaaga

SEQ ID NO: 723827 - DNA, 25 bp, Artificial sequence
  Synthetic oligonucleotide
tccaagaccgtcgaggccatgcgcg

SEQ ID NO: 723828 - DNA, 25 bp, Artificial sequence
  Synthetic oligonucleotide
accgtcgaggccatgcgcgacatct

SEQ ID NO: 723829 - DNA, 25 bp, Artificial sequence
  Synthetic oligonucleotide
tacttctccaagaccgtcgaggcca

SEQ ID NO: 723830 - DNA, 25 bp, Artificial sequence
  Synthetic oligonucleotide
atgcgcgacatctgcatcgctcgct

SEQ ID NO: 723831 - DNA, 25 bp, Artificial sequence
  Synthetic oligonucleotide
gacatctgcatcgctcgctacgaag

SEQ ID NO: 723832 - DNA, 25 bp, Artificial sequence
  Synthetic oligonucleotide
tgcatcgctcgctacgaagccttcg

SEQ ID NO: 723833 - DNA, 25 bp, Artificial sequence
  Synthetic oligonucleotide
gctcgctacgaagccttcggcaccg

SEQ ID NO: 723834 - DNA, 25 bp, Artificial sequence
  Synthetic oligonucleotide
tacgaagccttcggcaccgccggca

SEQ ID NO: 723835 - DNA, 25 bp, Artificial sequence
  Synthetic oligonucleotide
gccttcggcaccgccggcaacgctt

SEQ ID NO: 723836 - DNA, 25 bp, Artificial sequence
  Synthetic oligonucleotide
gcctgcccctgcggcaggcttctga

SEQ ID NO: 723837 - DNA, 25 bp, Artificial sequence
  Synthetic oligonucleotide
ggcaggggcgcggcgccgcgaccgc

SEQ ID NO: 723838 - DNA, 25 bp, Artificial sequence
  Synthetic oligonucleotide
gcgcggcgccgcgaccgctcctcgc

SEQ ID NO: 723839 - DNA, 25 bp, Artificial sequence
  Synthetic oligonucleotide
gccgcgaccgctcctcgcaaggaac

SEQ ID NO: 723840 - DNA, 25 bp, Artificial sequence
  Synthetic oligonucleotide
accgctcctcgcaaggaacttgaac

SEQ ID NO: 723841 - DNA, 25 bp, Artificial sequence
  Synthetic oligonucleotide
ttctgaatcactgaacgaccccgcg

SEQ ID NO: 723842 - DNA, 25 bp, Artificial sequence
  Synthetic oligonucleotide
tcctcgcaaggaacttgaaccgggc

SEQ ID NO: 723843 - DNA, 25 bp, Artificial sequence
  Synthetic oligonucleotide
gcaaggaacttgaaccgggcctgcc

SEQ ID NO: 723844 - DNA, 25 bp, Artificial sequence
  Synthetic oligonucleotide
aaccgggcctgcccctgcggcaggc

SEQ ID NO: 723845 - DNA, 25 bp, Artificial sequence
  Synthetic oligonucleotide
ccctgcggcaggcttctgaatcact

SEQ ID NO: 723846 - DNA, 25 bp, Artificial sequence
  Synthetic oligonucleotide
cgcgccggcaggggcgcggcgccgc

SEQ ID NO: 723847 - DNA, 25 bp, Artificial sequence
  Synthetic oligonucleotide
tactgggtcgaaaccgacgacctca

SEQ ID NO: 723848 - DNA, 25 bp, Artificial sequence
  Synthetic oligonucleotide
ggcaggcttctgaatcactgaacga

SEQ ID NO: 723849 - DNA, 25 bp, Artificial sequence
  Synthetic oligonucleotide
aacttgaaccgggcctgcccctgcg

SEQ ID NO: 723850 - DNA, 25 bp, Artificial sequence
  Synthetic oligonucleotide
ctgagtcgcgccggcaggggcgcgg

SEQ ID NO: 723851 - DNA, 25 bp, Artificial sequence
  Synthetic oligonucleotide
ggcgcgctgagtcgcgccggcaggg

SEQ ID NO: 723852 - DNA, 25 bp, Artificial sequence
  Synthetic oligonucleotide
ttgcaaggcgcgctgagtcgcgccg

SEQ ID NO: 723853 - DNA, 25 bp, Artificial sequence
  Synthetic oligonucleotide
tcgcggttgcaaggcgcgctgagtc

SEQ ID NO: 723854 - DNA, 25 bp, Artificial sequence
  Synthetic oligonucleotide
atcggtcgcggttgcaaggcgcgct

SEQ ID NO: 723855 - DNA, 25 bp, Artificial sequence
  Synthetic oligonucleotide
gacctcatcggtcgcggttgcaagg

SEQ ID NO: 723856 - DNA, 25 bp, Artificial sequence
  Synthetic oligonucleotide
gtcgaaaccgacgacctcatcggtc

SEQ ID NO: 723857 - DNA, 25 bp, Artificial sequence
  Synthetic oligonucleotide
gcctggtgtactgggtcgaaaccga

SEQ ID NO: 723858 - DNA, 25 bp, Artificial sequence
  Synthetic oligonucleotide
gacgaaggcctggtgtactgggtcg

SEQ ID NO: 723859 - DNA, 25 bp, Artificial sequence
  Synthetic oligonucleotide
gagaacgacgaaggcctggtgtact

SEQ ID NO: 723860 - DNA, 25 bp, Artificial sequence
  Synthetic oligonucleotide
cacctggagaacgacgaaggcctgg

SEQ ID NO: 723861 - DNA, 25 bp, Artificial sequence
  Synthetic oligonucleotide
ggcttccacctggagaacgacgaag

SEQ ID NO: 723862 - DNA, 25 bp, Artificial sequence
  Synthetic oligonucleotide
cgcctgggcttccacctggagaacg

SEQ ID NO: 723863 - DNA, 25 bp, Artificial sequence
  Synthetic oligonucleotide
atcactgaacgaccccgcgattggg

SEQ ID NO: 723864 - DNA, 25 bp, Artificial sequence
  Synthetic oligonucleotide
accgacgacctcatcggtcgcggtt

SEQ ID NO: 723865 - DNA, 25 bp, Artificial sequence
  Synthetic oligonucleotide
acggcgtgccggccttcaacgtcaa

SEQ ID NO: 723866 - DNA, 25 bp, Artificial sequence
  Synthetic oligonucleotide
ttccgccggtgctcgcaaatacgcc

SEQ ID NO: 723867 - DNA, 25 bp, Artificial sequence
  Synthetic oligonucleotide
ccaggcttccgccggtgctcgcaaa

SEQ ID NO: 723868 - DNA, 25 bp, Artificial sequence
  Synthetic oligonucleotide
cccgtgatcgtccaggcttccgccg

SEQ ID NO: 723869 - DNA, 25 bp, Artificial sequence
  Synthetic oligonucleotide
gattcgcccgtgatcgtccaggctt

SEQ ID NO: 723870 - DNA, 25 bp, Artificial sequence
  Synthetic oligonucleotide
aagaccgattcgcccgtgatcgtcc

SEQ ID NO: 723871 - DNA, 25 bp, Artificial sequence
  Synthetic oligonucleotide
gcggacaagaccgattcgcccgtga

SEQ ID NO: 723872 - DNA, 25 bp, Artificial sequence
  Synthetic oligonucleotide
gaagcggcggacaagaccgattcgc

SEQ ID NO: 723873 - DNA, 25 bp, Artificial sequence
  Synthetic oligonucleotide
atcatggaagcggcggacaagaccg

SEQ ID NO: 723874 - DNA, 25 bp, Artificial sequence
  Synthetic oligonucleotide
gcgccatcatggaagcggcggacaa

SEQ ID NO: 723875 - DNA, 25 bp, Artificial sequence
  Synthetic oligonucleotide
agatgcgcgccatcatggaagcggc

SEQ ID NO: 723876 - DNA, 25 bp, Artificial sequence
  Synthetic oligonucleotide
tcgagcagatgcgcgccatcatgga

SEQ ID NO: 723877 - DNA, 25 bp, Artificial sequence
  Synthetic oligonucleotide
acaacctcgagcagatgcgcgccat

SEQ ID NO: 723878 - DNA, 25 bp, Artificial sequence
  Synthetic oligonucleotide
acgtcaacaacctcgagcagatgcg

SEQ ID NO: 723879 - DNA, 25 bp, Artificial sequence
  Synthetic oligonucleotide
gatcgtccaggcttccgccggtgct

SEQ ID NO: 723880 - DNA, 25 bp, Artificial sequence
  Synthetic oligonucleotide
tgcgccagatgctggatcacgccgc

SEQ ID NO: 723881 - DNA, 25 bp, Artificial sequence
  Synthetic oligonucleotide
ccccgcgattgggagatacgagaac

SEQ ID NO: 723882 - DNA, 25 bp, Artificial sequence
  Synthetic oligonucleotide
gattgggagatacgagaaccatggc

SEQ ID NO: 723883 - DNA, 25 bp, Artificial sequence
  Synthetic oligonucleotide
gagatacgagaaccatggcactcat

SEQ ID NO: 723884 - DNA, 25 bp, Artificial sequence
  Synthetic oligonucleotide
cgagaaccatggcactcatcagcat

SEQ ID NO: 723885 - DNA, 25 bp, Artificial sequence
  Synthetic oligonucleotide
catggcactcatcagcatgcgccag

SEQ ID NO: 723886 - DNA, 25 bp, Artificial sequence
  Synthetic oligonucleotide
ccttcaacgtcaacaacctcgagca

SEQ ID NO: 723887 - DNA, 25 bp, Artificial sequence
  Synthetic oligonucleotide
cagcatgcgccagatgctggatcac

SEQ ID NO: 723888 - DNA, 25 bp, Artificial sequence
  Synthetic oligonucleotide
tgccggccttcaacgtcaacaacct

SEQ ID NO: 723889 - DNA, 25 bp, Artificial sequence
  Synthetic oligonucleotide
agatgctggatcacgccgccgaatt

SEQ ID NO: 723890 - DNA, 25 bp, Artificial sequence
  Synthetic oligonucleotide
tggatcacgccgccgaattcggcta

SEQ ID NO: 723891 - DNA, 25 bp, Artificial sequence
  Synthetic oligonucleotide
acgccgccgaattcggctacggcgt

SEQ ID NO: 723892 - DNA, 25 bp, Artificial sequence
  Synthetic oligonucleotide
ccgaattcggctacggcgtgccggc

SEQ ID NO: 723893 - DNA, 25 bp, Artificial sequence
  Synthetic oligonucleotide
tcggctacggcgtgccggccttcaa

SEQ ID NO: 723894 - DNA, 25 bp, Artificial sequence
  Synthetic oligonucleotide
gaacgaccccgcgattgggagatac

SEQ ID NO: 723895 - DNA, 25 bp, Artificial sequence
  Synthetic oligonucleotide
actcatcagcatgcgccagatgctg

SEQ ID NO: 723896 - DNA, 25 bp, Artificial sequence
  Synthetic oligonucleotide
tatcgccctgttcggcggcttcgcc

SEQ ID NO: 723897 - DNA, 25 bp, Artificial sequence
  Synthetic oligonucleotide
ggctgctccgcttcctccggcaagc

SEQ ID NO: 723898 - DNA, 25 bp, Artificial sequence
  Synthetic oligonucleotide
tccgcacggatggaggatggacatg

SEQ ID NO: 723899 - DNA, 25 bp, Artificial sequence
  Synthetic oligonucleotide
cggatggaggatggacatgaactac

SEQ ID NO: 723900 - DNA, 25 bp, Artificial sequence
  Synthetic oligonucleotide
gaggatggacatgaactactcgcgt

SEQ ID NO: 723901 - DNA, 25 bp, Artificial sequence
  Synthetic oligonucleotide
ggacatgaactactcgcgtatcgcc

SEQ ID NO: 723902 - DNA, 25 bp, Artificial sequence
  Synthetic oligonucleotide
gcggcggagcgttccgcacggatgg

SEQ ID NO: 723903 - DNA, 25 bp, Artificial sequence
  Synthetic oligonucleotide
tcgcgtatcgccctgttcggcggct

SEQ ID NO: 723904 - DNA, 25 bp, Artificial sequence
  Synthetic oligonucleotide
cgaggtgcggcggagcgttccgcac

SEQ ID NO: 723905 - DNA, 25 bp, Artificial sequence
  Synthetic oligonucleotide
cctgttcggcggcttcgccgccgcg

SEQ ID NO: 723906 - DNA, 25 bp, Artificial sequence
  Synthetic oligonucleotide
cggcggcttcgccgccgcggcgctg

SEQ ID NO: 723907 - DNA, 25 bp, Artificial sequence
  Synthetic oligonucleotide
cttcgccgccgcggcgctgctggcc

SEQ ID NO: 723908 - DNA, 25 bp, Artificial sequence
  Synthetic oligonucleotide
cgccgcggcgctgctggccggctgc

SEQ ID NO: 723909 - DNA, 25 bp, Artificial sequence
  Synthetic oligonucleotide
gcgctgctggccggctgctccgctt

SEQ ID NO: 723910 - DNA, 25 bp, Artificial sequence
  Synthetic oligonucleotide
agcattgcgcctttcctgtgacagg

SEQ ID NO: 723911 - DNA, 25 bp, Artificial sequence
  Synthetic oligonucleotide
gaactactcgcgtatcgccctgttc

SEQ ID NO: 723912 - DNA, 25 bp, Artificial sequence
  Synthetic oligonucleotide
aggcaaggccagccggccgccgcgc

SEQ ID NO: 723913 - DNA, 25 bp, Artificial sequence
  Synthetic oligonucleotide
ttcgccagcgtacgcagtagcattg

SEQ ID NO: 723914 - DNA, 25 bp, Artificial sequence
  Synthetic oligonucleotide
agcgtacgcagtagcattgcgcctt

SEQ ID NO: 723915 - DNA, 25 bp, Artificial sequence
  Synthetic oligonucleotide
cggaagaagccgccgacttcgtgaa

SEQ ID NO: 723916 - DNA, 25 bp, Artificial sequence
  Synthetic oligonucleotide
cgcagtagcattgcgcctttcctgt

SEQ ID NO: 723917 - DNA, 25 bp, Artificial sequence
  Synthetic oligonucleotide
gcgcctttcctgtgacaggcaaggc

SEQ ID NO: 723918 - DNA, 25 bp, Artificial sequence
  Synthetic oligonucleotide
gagcgttccgcacggatggaggatg

SEQ ID NO: 723919 - DNA, 25 bp, Artificial sequence
  Synthetic oligonucleotide
tgtgacaggcaaggccagccggccg

SEQ ID NO: 723920 - DNA, 25 bp, Artificial sequence
  Synthetic oligonucleotide
tccgcttcctccggcaagccgggcg

SEQ ID NO: 723921 - DNA, 25 bp, Artificial sequence
  Synthetic oligonucleotide
ggccagccggccgccgcgcgggccg

SEQ ID NO: 723922 - DNA, 25 bp, Artificial sequence
  Synthetic oligonucleotide
cggccgccgcgcgggccgcttgcgg

SEQ ID NO: 723923 - DNA, 25 bp, Artificial sequence
  Synthetic oligonucleotide
ccgcgcgggccgcttgcggcccggc

SEQ ID NO: 723924 - DNA, 25 bp, Artificial sequence
  Synthetic oligonucleotide
gggccgcttgcggcccggcgaggtg

SEQ ID NO: 723925 - DNA, 25 bp, Artificial sequence
  Synthetic oligonucleotide
ttgcggcccggcgaggtgcggcgga

SEQ ID NO: 723926 - DNA, 25 bp, Artificial sequence
  Synthetic oligonucleotide
gcccggcgaggtgcggcggagcgtt

SEQ ID NO: 723927 - DNA, 25 bp, Artificial sequence
  Synthetic oligonucleotide
tttcctgtgacaggcaaggccagcc

SEQ ID NO: 723928 - DNA, 25 bp, Artificial sequence
  Synthetic oligonucleotide
acttggagcaggaacctgcggccgt

SEQ ID NO: 723929 - DNA, 25 bp, Artificial sequence
  Synthetic oligonucleotide
ctggccggctgctccgcttcctccg

SEQ ID NO: 723930 - DNA, 25 bp, Artificial sequence
  Synthetic oligonucleotide
cctgcgcctgaaggacgaggacgac

SEQ ID NO: 723931 - DNA, 25 bp, Artificial sequence
  Synthetic oligonucleotide
cctgaaggacgaggacgacgtggtc

SEQ ID NO: 723932 - DNA, 25 bp, Artificial sequence
  Synthetic oligonucleotide
aggacgaggacgacgtggtccacca

SEQ ID NO: 723933 - DNA, 25 bp, Artificial sequence
  Synthetic oligonucleotide
aggacgacgtggtccaccacttgga

SEQ ID NO: 723934 - DNA, 25 bp, Artificial sequence
  Synthetic oligonucleotide
aacatcgtcgacctgcgcctgaagg

SEQ ID NO: 723935 - DNA, 25 bp, Artificial sequence
  Synthetic oligonucleotide
tccaccacttggagcaggaacctgc

SEQ ID NO: 723936 - DNA, 25 bp, Artificial sequence
  Synthetic oligonucleotide
cagcaagaacatcgtcgacctgcgc

SEQ ID NO: 723937 - DNA, 25 bp, Artificial sequence
  Synthetic oligonucleotide
gagcaggaacctgcggccgtcggcg

SEQ ID NO: 723938 - DNA, 25 bp, Artificial sequence
  Synthetic oligonucleotide
aacctgcggccgtcggcgctttcta

SEQ ID NO: 723939 - DNA, 25 bp, Artificial sequence
  Synthetic oligonucleotide
cggccgtcggcgctttctatagcga

SEQ ID NO: 723940 - DNA, 25 bp, Artificial sequence
  Synthetic oligonucleotide
tcggcgctttctatagcgacggacg

SEQ ID NO: 723941 - DNA, 25 bp, Artificial sequence
  Synthetic oligonucleotide
ctttctatagcgacggacgcctggg

SEQ ID NO: 723942 - DNA, 25 bp, Artificial sequence
  Synthetic oligonucleotide
tatagcgacggacgcctgggcttcc

SEQ ID NO: 723943 - DNA, 25 bp, Artificial sequence
  Synthetic oligonucleotide
acgtggtccaccacttggagcagga

SEQ ID NO: 723944 - DNA, 25 bp, Artificial sequence
  Synthetic oligonucleotide
tgcgacagcaaggcggtgatcgaat

SEQ ID NO: 723945 - DNA, 25 bp, Artificial sequence
  Synthetic oligonucleotide
ttcctccggcaagccgggcggcaag

SEQ ID NO: 723946 - DNA, 25 bp, Artificial sequence
  Synthetic oligonucleotide
ggcaagccgggcggcaaggactgga

SEQ ID NO: 723947 - DNA, 25 bp, Artificial sequence
  Synthetic oligonucleotide
cgggcggcaaggactggacccgctg

SEQ ID NO: 723948 - DNA, 25 bp, Artificial sequence
  Synthetic oligonucleotide
gcaaggactggacccgctggacctg

SEQ ID NO: 723949 - DNA, 25 bp, Artificial sequence
  Synthetic oligonucleotide
actggacccgctggacctgcgacag

SEQ ID NO: 723950 - DNA, 25 bp, Artificial sequence
  Synthetic oligonucleotide
cgtcgacctgcgcctgaaggacgag

SEQ ID NO: 723951 - DNA, 25 bp, Artificial sequence
  Synthetic oligonucleotide
tggacctgcgacagcaaggcggtga

SEQ ID NO: 723952 - DNA, 25 bp, Artificial sequence
  Synthetic oligonucleotide
gacggacgcctgggcttccacctgg

SEQ ID NO: 723953 - DNA, 25 bp, Artificial sequence
  Synthetic oligonucleotide
agcaaggcggtgatcgaatggcgct

SEQ ID NO: 723954 - DNA, 25 bp, Artificial sequence
  Synthetic oligonucleotide
gcggtgatcgaatggcgctatatcg

SEQ ID NO: 723955 - DNA, 25 bp, Artificial sequence
  Synthetic oligonucleotide
atcgaatggcgctatatcgacggca

SEQ ID NO: 723956 - DNA, 25 bp, Artificial sequence
  Synthetic oligonucleotide
tggcgctatatcgacggcagcaaga

SEQ ID NO: 723957 - DNA, 25 bp, Artificial sequence
  Synthetic oligonucleotide
tatatcgacggcagcaagaacatcg

SEQ ID NO: 723958 - DNA, 25 bp, Artificial sequence
  Synthetic oligonucleotide
gacggcagcaagaacatcgtcgacc

SEQ ID NO: 723959 - DNA, 25 bp, Artificial sequence
  Synthetic oligonucleotide
acccgctggacctgcgacagcaagg

SEQ ID NO: 723960 - DNA, 25 bp, Artificial sequence
  Synthetic oligonucleotide
acaccctgtcgatccagcgcatcaa

SEQ ID NO: 723961 - DNA, 25 bp, Artificial sequence
  Synthetic oligonucleotide
tcgtgaagaagaccaaggtcgacgc

SEQ ID NO: 723962 - DNA, 25 bp, Artificial sequence
  Synthetic oligonucleotide
cgcaggactggctggcgatcatcaa

SEQ ID NO: 723963 - DNA, 25 bp, Artificial sequence
  Synthetic oligonucleotide
cggtaccgcaggactggctggcgat

SEQ ID NO: 723964 - DNA, 25 bp, Artificial sequence
  Synthetic oligonucleotide
cttcctcggtaccgcaggactggct

SEQ ID NO: 723965 - DNA, 25 bp, Artificial sequence
  Synthetic oligonucleotide
acggctcttcctcggtaccgcagga

SEQ ID NO: 723966 - DNA, 25 bp, Artificial sequence
  Synthetic oligonucleotide
tgatgcacggctcttcctcggtacc

SEQ ID NO: 723967 - DNA, 25 bp, Artificial sequence
  Synthetic oligonucleotide
acctggtgatgcacggctcttcctc

SEQ ID NO: 723968 - DNA, 25 bp, Artificial sequence
  Synthetic oligonucleotide
acacccacctggtgatgcacggctc

SEQ ID NO: 723969 - DNA, 25 bp, Artificial sequence
  Synthetic oligonucleotide
tcccggacacccacctggtgatgca

SEQ ID NO: 723970 - DNA, 25 bp, Artificial sequence
  Synthetic oligonucleotide
cgcgcatcccggacacccacctggt

SEQ ID NO: 723971 - DNA, 25 bp, Artificial sequence
  Synthetic oligonucleotide
tccacgcgcgcatcccggacaccca

SEQ ID NO: 723972 - DNA, 25 bp, Artificial sequence
  Synthetic oligonucleotide
aggaaatccacgcgcgcatcccgga

SEQ ID NO: 723973 - DNA, 25 bp, Artificial sequence
  Synthetic oligonucleotide
gcatcaaggaaatccacgcgcgcat

SEQ ID NO: 723974 - DNA, 25 bp, Artificial sequence
  Synthetic oligonucleotide
tggcgatcatcaacgagtacggcgg

SEQ ID NO: 723975 - DNA, 25 bp, Artificial sequence
  Synthetic oligonucleotide
cacggcgcctacaagttcaccaagc

SEQ ID NO: 723976 - DNA, 25 bp, Artificial sequence
  Synthetic oligonucleotide
ttgctgaccgatccggaagaagccg

SEQ ID NO: 723977 - DNA, 25 bp, Artificial sequence
  Synthetic oligonucleotide
ccaaggtcgacgccctggccatcgc

SEQ ID NO: 723978 - DNA, 25 bp, Artificial sequence
  Synthetic oligonucleotide
tcgacgccctggccatcgccatcgg

SEQ ID NO: 723979 - DNA, 25 bp, Artificial sequence
  Synthetic oligonucleotide
cctggccatcgccatcggcaccagc

SEQ ID NO: 723980 - DNA, 25 bp, Artificial sequence
  Synthetic oligonucleotide
atcgccatcggcaccagccacggcg

SEQ ID NO: 723981 - DNA, 25 bp, Artificial sequence
  Synthetic oligonucleotide
tccagcgcatcaaggaaatccacgc

SEQ ID NO: 723982 - DNA, 25 bp, Artificial sequence
  Synthetic oligonucleotide
accagccacggcgcctacaagttca

SEQ ID NO: 723983 - DNA, 25 bp, Artificial sequence
  Synthetic oligonucleotide
tgtcgatccagcgcatcaaggaaat

SEQ ID NO: 723984 - DNA, 25 bp, Artificial sequence
  Synthetic oligonucleotide
gcctacaagttcaccaagccgccga

SEQ ID NO: 723985 - DNA, 25 bp, Artificial sequence
  Synthetic oligonucleotide
caagttcaccaagccgccgaccggg

SEQ ID NO: 723986 - DNA, 25 bp, Artificial sequence
  Synthetic oligonucleotide
tcaccaagccgccgaccggggacac

SEQ ID NO: 723987 - DNA, 25 bp, Artificial sequence
  Synthetic oligonucleotide
cgccgaccggggacaccctgtcgat

SEQ ID NO: 723988 - DNA, 25 bp, Artificial sequence
  Synthetic oligonucleotide
ccggggacaccctgtcgatccagcg

SEQ ID NO: 723989 - DNA, 25 bp, Artificial sequence
  Synthetic oligonucleotide
tcatcaacgagtacggcggcgagat

SEQ ID NO: 723990 - DNA, 25 bp, Artificial sequence
  Synthetic oligonucleotide
atcggcaccagccacggcgcctaca

SEQ ID NO: 723991 - DNA, 25 bp, Artificial sequence
  Synthetic oligonucleotide
tgcgcaaggtgaacatcgacaccga

SEQ ID NO: 723992 - DNA, 25 bp, Artificial sequence
  Synthetic oligonucleotide
gagttcgacccgcgcaagtacttct

SEQ ID NO: 723993 - DNA, 25 bp, Artificial sequence
  Synthetic oligonucleotide
tcctcgccgcggccggacacaaggt

SEQ ID NO: 723994 - DNA, 25 bp, Artificial sequence
  Synthetic oligonucleotide
tggggattcgccagcgtacgcagta

SEQ ID NO: 723995 - DNA, 25 bp, Artificial sequence
  Synthetic oligonucleotide
cccgagcgagttcgacccgcgcaag

SEQ ID NO: 723996 - DNA, 25 bp, Artificial sequence
  Synthetic oligonucleotide
gcagaacccgagcgagttcgacccg

SEQ ID NO: 723997 - DNA, 25 bp, Artificial sequence
  Synthetic oligonucleotide
cctggcgcagaacccgagcgagttc

SEQ ID NO: 723998 - DNA, 25 bp, Artificial sequence
  Synthetic oligonucleotide
cgcttcctggcgcagaacccgagcg

SEQ ID NO: 723999 - DNA, 25 bp, Artificial sequence
  Synthetic oligonucleotide
catccgccgcttcctggcgcagaac

SEQ ID NO: 724000 - DNA, 25 bp, Artificial sequence
  Synthetic oligonucleotide
cggtgccatccgccgcttcctggcg

SEQ ID NO: 724001 - DNA, 25 bp, Artificial sequence
  Synthetic oligonucleotide
ctccaccggtgccatccgccgcttc

SEQ ID NO: 724002 - DNA, 25 bp, Artificial sequence
  Synthetic oligonucleotide
gcctggcctccaccggtgccatccg

SEQ ID NO: 724003 - DNA, 25 bp, Artificial sequence
  Synthetic oligonucleotide
acctgcgcctggcctccaccggtgc

SEQ ID NO: 724004 - DNA, 25 bp, Artificial sequence
  Synthetic oligonucleotide
acaccgacctgcgcctggcctccac

SEQ ID NO: 724005 - DNA, 25 bp, Artificial sequence
  Synthetic oligonucleotide
actggctggcgatcatcaacgagta

SEQ ID NO: 724006 - DNA, 25 bp, Artificial sequence
  Synthetic oligonucleotide
gtcgaggaaatcgtcgagggcatca

SEQ ID NO: 724007 - DNA, 25 bp, Artificial sequence
  Synthetic oligonucleotide
acgagtacggcggcgagatcaaaga

SEQ ID NO: 724008 - DNA, 25 bp, Artificial sequence
  Synthetic oligonucleotide
acggcggcgagatcaaagagaccta

SEQ ID NO: 724009 - DNA, 25 bp, Artificial sequence
  Synthetic oligonucleotide
gcgagatcaaagagacctacggcgt

SEQ ID NO: 724010 - DNA, 25 bp, Artificial sequence
  Synthetic oligonucleotide
tcaaagagacctacggcgtgccggt

SEQ ID NO: 724011 - DNA, 25 bp, Artificial sequence
  Synthetic oligonucleotide
agacctacggcgtgccggtcgagga

SEQ ID NO: 724012 - DNA, 25 bp, Artificial sequence
  Synthetic oligonucleotide
acatcgacaccgacctgcgcctggc

SEQ ID NO: 724013 - DNA, 25 bp, Artificial sequence
  Synthetic oligonucleotide
gtgccggtcgaggaaatcgtcgagg

SEQ ID NO: 724014 - DNA, 25 bp, Artificial sequence
  Synthetic oligonucleotide
aggtgaacatcgacaccgacctgcg

SEQ ID NO: 724015 - DNA, 25 bp, Artificial sequence
  Synthetic oligonucleotide
ggaaatcgtcgagggcatcaagtac

SEQ ID NO: 724016 - DNA, 25 bp, Artificial sequence
  Synthetic oligonucleotide
tcgtcgagggcatcaagtacggcgt

SEQ ID NO: 724017 - DNA, 25 bp, Artificial sequence
  Synthetic oligonucleotide
agggcatcaagtacggcgtgcgcaa

SEQ ID NO: 724018 - DNA, 25 bp, Artificial sequence
  Synthetic oligonucleotide
tcaagtacggcgtgcgcaaggtgaa

SEQ ID NO: 724019 - DNA, 25 bp, Artificial sequence
  Synthetic oligonucleotide
acggcgtgcgcaaggtgaacatcga

SEQ ID NO: 724020 - DNA, 25 bp, Artificial sequence
  Synthetic oligonucleotide
ccgacttcgtgaagaagaccaaggt

SEQ ID NO: 724021 - DNA, 25 bp, Artificial sequence
  Synthetic oligonucleotide
acggcgtgccggtcgaggaaatcgt

SEQ ID NO: 724022 - DNA, 25 bp, Artificial sequence
  Synthetic oligonucleotide
gtcatgcaccaggatcacggcacca

SEQ ID NO: 724023 - DNA, 25 bp, Artificial sequence
  Synthetic oligonucleotide
agaagaccaaggtcgacgccctggc

SEQ ID NO: 724024 - DNA, 25 bp, Artificial sequence
  Synthetic oligonucleotide
cctgcgtgaagacggcaagacccct

SEQ ID NO: 724025 - DNA, 25 bp, Artificial sequence
  Synthetic oligonucleotide
acggctccctgcgtgaagacggcaa

SEQ ID NO: 724026 - DNA, 25 bp, Artificial sequence
  Synthetic oligonucleotide
atgatggacggctccctgcgtgaag

SEQ ID NO: 724027 - DNA, 25 bp, Artificial sequence
  Synthetic oligonucleotide
ctcggtgatgatggacggctccctg

SEQ ID NO: 724028 - DNA, 25 bp, Artificial sequence
  Synthetic oligonucleotide
cttcagctcggtgatgatggacggc

SEQ ID NO: 724029 - DNA, 25 bp, Artificial sequence
  Synthetic oligonucleotide
gctgggcttcagctcggtgatgatg

SEQ ID NO: 724030 - DNA, 25 bp, Artificial sequence
  Synthetic oligonucleotide
catccagctgggcttcagctcggtg

SEQ ID NO: 724031 - DNA, 25 bp, Artificial sequence
  Synthetic oligonucleotide
agcgttccatccagctgggcttcag

SEQ ID NO: 724032 - DNA, 25 bp, Artificial sequence
  Synthetic oligonucleotide
tctgccagcgttccatccagctggg

SEQ ID NO: 724033 - DNA, 25 bp, Artificial sequence
  Synthetic oligonucleotide
ccgacgtctgccagcgttccatcca

SEQ ID NO: 724034 - DNA, 25 bp, Artificial sequence
  Synthetic oligonucleotide
ccagtcccgacgtctgccagcgttc

SEQ ID NO: 724035 - DNA, 25 bp, Artificial sequence
  Synthetic oligonucleotide
acggcaccagtcccgacgtctgcca

SEQ ID NO: 724036 - DNA, 25 bp, Artificial sequence
  Synthetic oligonucleotide
acggcaagacccctgccgactacga

SEQ ID NO: 724037 - DNA, 25 bp, Artificial sequence
  Synthetic oligonucleotide
tcgccgcgatcgaagaattcccgca

SEQ ID NO: 724038 - DNA, 25 bp, Artificial sequence
  Synthetic oligonucleotide
tcgcaaatacgccggcgcgcccttc

SEQ ID NO: 724039 - DNA, 25 bp, Artificial sequence
  Synthetic oligonucleotide
aatacgccggcgcgcccttcctgcg

SEQ ID NO: 724040 - DNA, 25 bp, Artificial sequence
  Synthetic oligonucleotide
ccggcgcgcccttcctgcgccacct

SEQ ID NO: 724041 - DNA, 25 bp, Artificial sequence
  Synthetic oligonucleotide
cgcccttcctgcgccacctgatcct

SEQ ID NO: 724042 - DNA, 25 bp, Artificial sequence
  Synthetic oligonucleotide
tcctgcgccacctgatcctcgccgc

SEQ ID NO: 724043 - DNA, 25 bp, Artificial sequence
  Synthetic oligonucleotide
aggatcacggcaccagtcccgacgt

SEQ ID NO: 724044 - DNA, 25 bp, Artificial sequence
  Synthetic oligonucleotide
tgatcctcgccgcgatcgaagaatt

SEQ ID NO: 724045 - DNA, 25 bp, Artificial sequence
  Synthetic oligonucleotide
gcaccaggatcacggcaccagtccc

SEQ ID NO: 724046 - DNA, 25 bp, Artificial sequence
  Synthetic oligonucleotide
gcgatcgaagaattcccgcacatcc

SEQ ID NO: 724047 - DNA, 25 bp, Artificial sequence
  Synthetic oligonucleotide
gaagaattcccgcacatcccggtgg

SEQ ID NO: 724048 - DNA, 25 bp, Artificial sequence
  Synthetic oligonucleotide
attcccgcacatcccggtggtcatg

SEQ ID NO: 724049 - DNA, 25 bp, Artificial sequence
  Synthetic oligonucleotide
gcacatcccggtggtcatgcaccag

SEQ ID NO: 724050 - DNA, 25 bp, Artificial sequence
  Synthetic oligonucleotide
ccggtggtcatgcaccaggatcacg

SEQ ID NO: 724051 - DNA, 25 bp, Artificial sequence
  Synthetic oligonucleotide
agacccctgccgactacgactacaa

SEQ ID NO: 724052 - DNA, 25 bp, Artificial sequence
  Synthetic oligonucleotide
gccacctgatcctcgccgcgatcga

SEQ ID NO: 724053 - DNA, 25 bp, Artificial sequence
  Synthetic oligonucleotide
ggcgagctgggctgcctgggttccc

SEQ ID NO: 724054 - DNA, 25 bp, Artificial sequence
  Synthetic oligonucleotide
aagccgccgacttcgtgaagaagac

SEQ ID NO: 724055 - DNA, 25 bp, Artificial sequence
  Synthetic oligonucleotide
accgatccggaagaagccgccgact

SEQ ID NO: 724056 - DNA, 25 bp, Artificial sequence
  Synthetic oligonucleotide
gccagttgctgaccgatccggaaga

SEQ ID NO: 724057 - DNA, 25 bp, Artificial sequence
  Synthetic oligonucleotide
accacagccagttgctgaccgatcc

SEQ ID NO: 724058 - DNA, 25 bp, Artificial sequence
  Synthetic oligonucleotide
tgctggaccacagccagttgctgac

SEQ ID NO: 724059 - DNA, 25 bp, Artificial sequence
  Synthetic oligonucleotide
gaaggcgtgctggaccacagccagt

SEQ ID NO: 724060 - DNA, 25 bp, Artificial sequence
  Synthetic oligonucleotide
ggcgcggaaggcgtgctggaccaca

SEQ ID NO: 724061 - DNA, 25 bp, Artificial sequence
  Synthetic oligonucleotide
cggcgtcggcgcggaaggcgtgctg

SEQ ID NO: 724062 - DNA, 25 bp, Artificial sequence
  Synthetic oligonucleotide
ggaagacggcgtcggcgcggaaggc

SEQ ID NO: 724063 - DNA, 25 bp, Artificial sequence
  Synthetic oligonucleotide
ccggcgaggaagacggcgtcggcgc

SEQ ID NO: 724064 - DNA, 25 bp, Artificial sequence
  Synthetic oligonucleotide
ggcatggccggcgaggaagacggcg

SEQ ID NO: 724065 - DNA, 25 bp, Artificial sequence
  Synthetic oligonucleotide
ggaaaccggcatggccggcgaggaa

SEQ ID NO: 724066 - DNA, 25 bp, Artificial sequence
  Synthetic oligonucleotide
ttccctggaaaccggcatggccggc

SEQ ID NO: 724067 - DNA, 25 bp, Artificial sequence
  Synthetic oligonucleotide
gtgaagacggcaagacccctgccga

SEQ ID NO: 724068 - DNA, 25 bp, Artificial sequence
  Synthetic oligonucleotide
tggcgttcgcccatgcctgcggcgt

SEQ ID NO: 724069 - DNA, 25 bp, Artificial sequence
  Synthetic oligonucleotide
tgccgactacgactacaacgtccgt

SEQ ID NO: 724070 - DNA, 25 bp, Artificial sequence
  Synthetic oligonucleotide
ctacgactacaacgtccgtgtgacc

SEQ ID NO: 724071 - DNA, 25 bp, Artificial sequence
  Synthetic oligonucleotide
ctacaacgtccgtgtgacccagcag

SEQ ID NO: 724072 - DNA, 25 bp, Artificial sequence
  Synthetic oligonucleotide
acgtccgtgtgacccagcagaccgt

SEQ ID NO: 724073 - DNA, 25 bp, Artificial sequence
  Synthetic oligonucleotide
gtgtgacccagcagaccgtggcgtt

SEQ ID NO: 724074 - DNA, 25 bp, Artificial sequence
  Synthetic oligonucleotide
cctgggttccctggaaaccggcatg

SEQ ID NO: 724075 - DNA, 25 bp, Artificial sequence
  Synthetic oligonucleotide
agaccgtggcgttcgcccatgcctg

SEQ ID NO: 724076 - DNA, 25 bp, Artificial sequence
  Synthetic oligonucleotide
tgggctgcctgggttccctggaaac

SEQ ID NO: 724077 - DNA, 25 bp, Artificial sequence
  Synthetic oligonucleotide
tcgcccatgcctgcggcgtgtccgt

SEQ ID NO: 724078 - DNA, 25 bp, Artificial sequence
  Synthetic oligonucleotide
atgcctgcggcgtgtccgtggaagg

SEQ ID NO: 724079 - DNA, 25 bp, Artificial sequence
  Synthetic oligonucleotide
gcggcgtgtccgtggaaggcgagct

SEQ ID NO: 724080 - DNA, 25 bp, Artificial sequence
  Synthetic oligonucleotide
gtgtccgtggaaggcgagctgggct

SEQ ID NO: 724081 - DNA, 25 bp, Artificial sequence
  Synthetic oligonucleotide
gtggaaggcgagctgggctgcctgg

SEQ ID NO: 724082 - DNA, 25 bp, Artificial sequence
  Synthetic oligonucleotide
cggtgctcgcaaatacgccggcgcg

SEQ ID NO: 724083 - DNA, 25 bp, Artificial sequence
  Synthetic oligonucleotide
cccagcagaccgtggcgttcgccca

SEQ ID NO: 724084 - DNA, 25 bp, Artificial sequence
  Synthetic oligonucleotide
ctggcgcagaagtacgccgcgctgt

SEQ ID NO: 724085 - DNA, 25 bp, Artificial sequence
  Synthetic oligonucleotide
tcgacggcgtcgaggtcaaggcggg

SEQ ID NO: 724086 - DNA, 25 bp, Artificial sequence
  Synthetic oligonucleotide
tggccaggttcgccaaggtcgccgc

SEQ ID NO: 724087 - DNA, 25 bp, Artificial sequence
  Synthetic oligonucleotide
acggcgtggccaggttcgccaaggt

SEQ ID NO: 724088 - DNA, 25 bp, Artificial sequence
  Synthetic oligonucleotide
cgacccacggcgtggccaggttcgc

SEQ ID NO: 724089 - DNA, 25 bp, Artificial sequence
  Synthetic oligonucleotide
aggggtcgacccacggcgtggccag

SEQ ID NO: 724090 - DNA, 25 bp, Artificial sequence
  Synthetic oligonucleotide
cgccgaggggtcgacccacggcgtg

SEQ ID NO: 724091 - DNA, 25 bp, Artificial sequence
  Synthetic oligonucleotide
caccgcgccgaggggtcgacccacg

SEQ ID NO: 724092 - DNA, 25 bp, Artificial sequence
  Synthetic oligonucleotide
cttcggtaccgcccaccgcgccgag

SEQ ID NO: 724093 - DNA, 25 bp, Artificial sequence
  Synthetic oligonucleotide
gatgccttcggtaccgcccaccgcg

SEQ ID NO: 724094 - DNA, 25 bp, Artificial sequence
  Synthetic oligonucleotide
gtgatggatgccttcggtaccgccc

SEQ ID NO: 724095 - DNA, 25 bp, Artificial sequence
  Synthetic oligonucleotide
gtgttcgtgatggatgccttcggta

SEQ ID NO: 724096 - DNA, 25 bp, Artificial sequence
  Synthetic oligonucleotide
tgcgacgtgttcgtgatggatgcct

SEQ ID NO: 724097 - DNA, 25 bp, Artificial sequence
  Synthetic oligonucleotide
gcgctgtgcgacgtgttcgtgatgg

SEQ ID NO: 724098 - DNA, 25 bp, Artificial sequence
  Synthetic oligonucleotide
ccaaggtcgccgccgccggcccgct

SEQ ID NO: 724099 - DNA, 25 bp, Artificial sequence
  Synthetic oligonucleotide
tgcgcttcaacaagggcgagaagaa

SEQ ID NO: 724100 - DNA, 25 bp, Artificial sequence
  Synthetic oligonucleotide
ccgcggccggacacaaggtcggcaa

SEQ ID NO: 724101 - DNA, 25 bp, Artificial sequence
  Synthetic oligonucleotide
aggtcaaggcgggcgacctggtgct

SEQ ID NO: 724102 - DNA, 25 bp, Artificial sequence
  Synthetic oligonucleotide
aggcgggcgacctggtgctgttcga

SEQ ID NO: 724103 - DNA, 25 bp, Artificial sequence
  Synthetic oligonucleotide
gcgacctggtgctgttcgagaacgt

SEQ ID NO: 724104 - DNA, 25 bp, Artificial sequence
  Synthetic oligonucleotide
tggtgctgttcgagaacgtgcgctt

SEQ ID NO: 724105 - DNA, 25 bp, Artificial sequence
  Synthetic oligonucleotide
tacgccgcgctgtgcgacgtgttcg

SEQ ID NO: 724106 - DNA, 25 bp, Artificial sequence
  Synthetic oligonucleotide
agaacgtgcgcttcaacaagggcga

SEQ ID NO: 724107 - DNA, 25 bp, Artificial sequence
  Synthetic oligonucleotide
cagaagtacgccgcgctgtgcgacg

SEQ ID NO: 724108 - DNA, 25 bp, Artificial sequence
  Synthetic oligonucleotide
tcaacaagggcgagaagaagaacgc

SEQ ID NO: 724109 - DNA, 25 bp, Artificial sequence
  Synthetic oligonucleotide
agggcgagaagaagaacgccgacga

SEQ ID NO: 724110 - DNA, 25 bp, Artificial sequence
  Synthetic oligonucleotide
agaagaagaacgccgacgagctggc

SEQ ID NO: 724111 - DNA, 25 bp, Artificial sequence
  Synthetic oligonucleotide
agaacgccgacgagctggcgcagaa

SEQ ID NO: 724112 - DNA, 25 bp, Artificial sequence
  Synthetic oligonucleotide
cgacgagctggcgcagaagtacgcc

SEQ ID NO: 724113 - DNA, 25 bp, Artificial sequence
  Synthetic oligonucleotide
tcgccgccgccggcccgctgctggc

SEQ ID NO: 724114 - DNA, 25 bp, Artificial sequence
  Synthetic oligonucleotide
tgttcgagaacgtgcgcttcaacaa

SEQ ID NO: 724115 - DNA, 25 bp, Artificial sequence
  Synthetic oligonucleotide
cgccggctccaaggtttccaccaag

SEQ ID NO: 724116 - DNA, 25 bp, Artificial sequence
  Synthetic oligonucleotide
ccggacacaaggtcggcaagtcact

SEQ ID NO: 724117 - DNA, 25 bp, Artificial sequence
  Synthetic oligonucleotide
tcgccaacaccttcctcgccgcggc

SEQ ID NO: 724118 - DNA, 25 bp, Artificial sequence
  Synthetic oligonucleotide
gcggcatcgccaacaccttcctcgc

SEQ ID NO: 724119 - DNA, 25 bp, Artificial sequence
  Synthetic oligonucleotide
tcggcggcggcatcgccaacacctt

SEQ ID NO: 724120 - DNA, 25 bp, Artificial sequence
  Synthetic oligonucleotide
tgatcgtcggcggcggcatcgccaa

SEQ ID NO: 724121 - DNA, 25 bp, Artificial sequence
  Synthetic oligonucleotide
ccaactgatcgtcggcggcggcatc

SEQ ID NO: 724122 - DNA, 25 bp, Artificial sequence
  Synthetic oligonucleotide
tgcgaccaactgatcgtcggcggcg

SEQ ID NO: 724123 - DNA, 25 bp, Artificial sequence
  Synthetic oligonucleotide
gcatctgcgaccaactgatcgtcgg

SEQ ID NO: 724124 - DNA, 25 bp, Artificial sequence
  Synthetic oligonucleotide
tggccggcatctgcgaccaactgat

SEQ ID NO: 724125 - DNA, 25 bp, Artificial sequence
  Synthetic oligonucleotide
acagcctggccggcatctgcgacca

SEQ ID NO: 724126 - DNA, 25 bp, Artificial sequence
  Synthetic oligonucleotide
tgctgaacagcctggccggcatctg

SEQ ID NO: 724127 - DNA, 25 bp, Artificial sequence
  Synthetic oligonucleotide
tcgacgtgctgaacagcctggccgg

SEQ ID NO: 724128 - DNA, 25 bp, Artificial sequence
  Synthetic oligonucleotide
ccaagctcgacgtgctgaacagcct

SEQ ID NO: 724129 - DNA, 25 bp, Artificial sequence
  Synthetic oligonucleotide
aggttcgccaaggtcgccgccgccg

SEQ ID NO: 724130 - DNA, 25 bp, Artificial sequence
  Synthetic oligonucleotide
ggcgctgggcaacccggcgcggccg

SEQ ID NO: 724131 - DNA, 25 bp, Artificial sequence
  Synthetic oligonucleotide
ccgccggcccgctgctggccgccga

SEQ ID NO: 724132 - DNA, 25 bp, Artificial sequence
  Synthetic oligonucleotide
gcccgctgctggccgccgaactgga

SEQ ID NO: 724133 - DNA, 25 bp, Artificial sequence
  Synthetic oligonucleotide
tgctggccgccgaactggacgcgct

SEQ ID NO: 724134 - DNA, 25 bp, Artificial sequence
  Synthetic oligonucleotide
ccgccgaactggacgcgctgggcaa

SEQ ID NO: 724135 - DNA, 25 bp, Artificial sequence
  Synthetic oligonucleotide
aactggacgcgctgggcaaggcgct

SEQ ID NO: 724136 - DNA, 25 bp, Artificial sequence
  Synthetic oligonucleotide
gtttccaccaagctcgacgtgctga

SEQ ID NO: 724137 - DNA, 25 bp, Artificial sequence
  Synthetic oligonucleotide
tgggcaaggcgctgggcaacccggc

SEQ ID NO: 724138 - DNA, 25 bp, Artificial sequence
  Synthetic oligonucleotide
tccaaggtttccaccaagctcgacg

SEQ ID NO: 724139 - DNA, 25 bp, Artificial sequence
  Synthetic oligonucleotide
gggcaacccggcgcggccgatggcg

SEQ ID NO: 724140 - DNA, 25 bp, Artificial sequence
  Synthetic oligonucleotide
ccggcgcggccgatggcggcgatcg

SEQ ID NO: 724141 - DNA, 25 bp, Artificial sequence
  Synthetic oligonucleotide
cggccgatggcggcgatcgtcgccg

SEQ ID NO: 724142 - DNA, 25 bp, Artificial sequence
  Synthetic oligonucleotide
tggcggcgatcgtcgccggctccaa

SEQ ID NO: 724143 - DNA, 25 bp, Artificial sequence
  Synthetic oligonucleotide
gatcgtcgccggctccaaggtttcc

SEQ ID NO: 724144 - DNA, 25 bp, Artificial sequence
  Synthetic oligonucleotide
actacctcgacggcgtcgaggtcaa

SEQ ID NO: 724145 - DNA, 25 bp, Artificial sequence
  Synthetic oligonucleotide
acgcgctgggcaaggcgctgggcaa

SEQ ID NO: 724146 - DNA, 25 bp, Artificial sequence
  Synthetic oligonucleotide
ttgtcatgaccgtgttgaagatgac

SEQ ID NO: 724147 - DNA, 25 bp, Artificial sequence
  Synthetic oligonucleotide
gcgtcgaggtcaaggcgggcgacct

SEQ ID NO: 724148 - DNA, 25 bp, Artificial sequence
  Synthetic oligonucleotide
gacggccaggtgcagagcgatgcac

SEQ ID NO: 724149 - DNA, 25 bp, Artificial sequence
  Synthetic oligonucleotide
gtgaaggacggccaggtgcagagcg

SEQ ID NO: 724150 - DNA, 25 bp, Artificial sequence
  Synthetic oligonucleotide
gtgcccgtgaaggacggccaggtgc

SEQ ID NO: 724151 - DNA, 25 bp, Artificial sequence
  Synthetic oligonucleotide
ctcaacgtgcccgtgaaggacggcc

SEQ ID NO: 724152 - DNA, 25 bp, Artificial sequence
  Synthetic oligonucleotide
gaggacctcaacgtgcccgtgaagg

SEQ ID NO: 724153 - DNA, 25 bp, Artificial sequence
  Synthetic oligonucleotide
atccgcgaggacctcaacgtgcccg

SEQ ID NO: 724154 - DNA, 25 bp, Artificial sequence
  Synthetic oligonucleotide
gtgctgatccgcgaggacctcaacg

SEQ ID NO: 724155 - DNA, 25 bp, Artificial sequence
  Synthetic oligonucleotide
taagcgcgtgctgatccgcgaggac

SEQ ID NO: 724156 - DNA, 25 bp, Artificial sequence
  Synthetic oligonucleotide
tcaaaggtaagcgcgtgctgatccg

SEQ ID NO: 724157 - DNA, 25 bp, Artificial sequence
  Synthetic oligonucleotide
tcgacctcaaaggtaagcgcgtgct

SEQ ID NO: 724158 - DNA, 25 bp, Artificial sequence
  Synthetic oligonucleotide
ctgacctcgacctcaaaggtaagcg

SEQ ID NO: 724159 - DNA, 25 bp, Artificial sequence
  Synthetic oligonucleotide
agatgactgacctcgacctcaaagg

SEQ ID NO: 724160 - DNA, 25 bp, Artificial sequence
  Synthetic oligonucleotide
cagagcgatgcacggatcaaggccg

SEQ ID NO: 724161 - DNA, 25 bp, Artificial sequence
  Synthetic oligonucleotide
ccgccgtgcctgatcaacaagtacc

SEQ ID NO: 724162 - DNA, 25 bp, Artificial sequence
  Synthetic oligonucleotide
gacccgcgcaagtacttctccaaga

SEQ ID NO: 724163 - DNA, 25 bp, Artificial sequence
  Synthetic oligonucleotide
accgtatgctcgacgtcgccggaca

SEQ ID NO: 724164 - DNA, 25 bp, Artificial sequence
  Synthetic oligonucleotide
tgctcgacgtcgccggacactacct

SEQ ID NO: 724165 - DNA, 25 bp, Artificial sequence
  Synthetic oligonucleotide
acgtcgccggacactacctgcgcgc

SEQ ID NO: 724166 - DNA, 25 bp, Artificial sequence
  Synthetic oligonucleotide
ccggacactacctgcgcgccgccgt

SEQ ID NO: 724167 - DNA, 25 bp, Artificial sequence
  Synthetic oligonucleotide
tgttgaagatgactgacctcgacct

SEQ ID NO: 724168 - DNA, 25 bp, Artificial sequence
  Synthetic oligonucleotide
tgcgcgccgccgtgcctgatcaaca

SEQ ID NO: 724169 - DNA, 25 bp, Artificial sequence
  Synthetic oligonucleotide
tgaccgtgttgaagatgactgacct

SEQ ID NO: 724170 - DNA, 25 bp, Artificial sequence
  Synthetic oligonucleotide
tgcctgatcaacaagtacccaagga

SEQ ID NO: 724171 - DNA, 25 bp, Artificial sequence
  Synthetic oligonucleotide
gatcaacaagtacccaaggactgat

SEQ ID NO: 724172 - DNA, 25 bp, Artificial sequence
  Synthetic oligonucleotide
caagtacccaaggactgattgtcat

SEQ ID NO: 724173 - DNA, 25 bp, Artificial sequence
  Synthetic oligonucleotide
cccaaggactgattgtcatgaccgt

SEQ ID NO: 724174 - DNA, 25 bp, Artificial sequence
  Synthetic oligonucleotide
gactgattgtcatgaccgtgttgaa

SEQ ID NO: 724175 - DNA, 25 bp, Artificial sequence
  Synthetic oligonucleotide
gatgcacggatcaaggccgccctgc

SEQ ID NO: 724176 - DNA, 25 bp, Artificial sequence
  Synthetic oligonucleotide
actacctgcgcgccgccgtgcctga

SEQ ID NO: 724177 - DNA, 25 bp, Artificial sequence
  Synthetic oligonucleotide
cgtccgaccgagggcgagttctccg

SEQ ID NO: 724178 - DNA, 25 bp, Artificial sequence
  Synthetic oligonucleotide
tggccgactacctcgacggcgtcga

SEQ ID NO: 724179 - DNA, 25 bp, Artificial sequence
  Synthetic oligonucleotide
cgctgctggccgactacctcgacgg

SEQ ID NO: 724180 - DNA, 25 bp, Artificial sequence
  Synthetic oligonucleotide
aagtgccgctgctggccgactacct

SEQ ID NO: 724181 - DNA, 25 bp, Artificial sequence
  Synthetic oligonucleotide
gccgcgaagtgccgctgctggccga

SEQ ID NO: 724182 - DNA, 25 bp, Artificial sequence
  Synthetic oligonucleotide
ccctgggccgcgaagtgccgctgct

SEQ ID NO: 724183 - DNA, 25 bp, Artificial sequence
  Synthetic oligonucleotide
ccaaggccctgggccgcgaagtgcc

SEQ ID NO: 724184 - DNA, 25 bp, Artificial sequence
  Synthetic oligonucleotide
acctgtccaaggccctgggccgcga

SEQ ID NO: 724185 - DNA, 25 bp, Artificial sequence
  Synthetic oligonucleotide
ccgagtacctgtccaaggccctggg

SEQ ID NO: 724186 - DNA, 25 bp, Artificial sequence
  Synthetic oligonucleotide
cggtggccgagtacctgtccaaggc

SEQ ID NO: 724187 - DNA, 25 bp, Artificial sequence
  Synthetic oligonucleotide
tgaagccggtggccgagtacctgtc

SEQ ID NO: 724188 - DNA, 25 bp, Artificial sequence
  Synthetic oligonucleotide
aacagcctgaagccggtggccgagt

SEQ ID NO: 724189 - DNA, 25 bp, Artificial sequence
  Synthetic oligonucleotide
gccgagaacagcctgaagccggtgg

SEQ ID NO: 724190 - DNA, 25 bp, Artificial sequence
  Synthetic oligonucleotide
ttctccgccgagaacagcctgaagc

SEQ ID NO: 724191 - DNA, 25 bp, Artificial sequence
  Synthetic oligonucleotide
caggtgcagagcgatgcacggatca

SEQ ID NO: 724192 - DNA, 25 bp, Artificial sequence
  Synthetic oligonucleotide
gggcgcggcggtgatggtctgctcg

SEQ ID NO: 724193 - DNA, 25 bp, Artificial sequence
  Synthetic oligonucleotide
acggatcaaggccgccctgccgacc

SEQ ID NO: 724194 - DNA, 25 bp, Artificial sequence
  Synthetic oligonucleotide
caaggccgccctgccgaccctcaag

SEQ ID NO: 724195 - DNA, 25 bp, Artificial sequence
  Synthetic oligonucleotide
gccctgccgaccctcaagctggccc

SEQ ID NO: 724196 - DNA, 25 bp, Artificial sequence
  Synthetic oligonucleotide
cgaccctcaagctggccctggagaa

SEQ ID NO: 724197 - DNA, 25 bp, Artificial sequence
  Synthetic oligonucleotide
tcaagctggccctggagaagggcgc

SEQ ID NO: 724198 - DNA, 25 bp, Artificial sequence
  Synthetic oligonucleotide
gcgagttctccgccgagaacagcct

SEQ ID NO: 724199 - DNA, 25 bp, Artificial sequence
  Synthetic oligonucleotide
ggagaagggcgcggcggtgatggtc

SEQ ID NO: 724200 - DNA, 25 bp, Artificial sequence
  Synthetic oligonucleotide
accgagggcgagttctccgccgaga

SEQ ID NO: 724201 - DNA, 25 bp, Artificial sequence
  Synthetic oligonucleotide
cggcggtgatggtctgctcgcacct

SEQ ID NO: 724202 - DNA, 25 bp, Artificial sequence
  Synthetic oligonucleotide
gtgatggtctgctcgcacctgggcc

SEQ ID NO: 724203 - DNA, 25 bp, Artificial sequence
  Synthetic oligonucleotide
gtctgctcgcacctgggccgtccga

SEQ ID NO: 724204 - DNA, 25 bp, Artificial sequence
  Synthetic oligonucleotide
tcgcacctgggccgtccgaccgagg

SEQ ID NO: 724205 - DNA, 25 bp, Artificial sequence
  Synthetic oligonucleotide
ctgggccgtccgaccgagggcgagt

SEQ ID NO: 724206 - DNA, 25 bp, Artificial sequence
  Synthetic oligonucleotide
acaaggtcggcaagtcactgtacga

SEQ ID NO: 724207 - DNA, 25 bp, Artificial sequence
  Synthetic oligonucleotide
tggccctggagaagggcgcggcggt

SEQ ID NO: 724208 - DNA, 25 bp, Artificial sequence
  Synthetic oligonucleotide
aagggctgacgcagacggggcaaac

SEQ ID NO: 724209 - DNA, 25 bp, Artificial sequence
  Synthetic oligonucleotide
tatatttccaccggtggcggcgcgt

SEQ ID NO: 724210 - DNA, 25 bp, Artificial sequence
  Synthetic oligonucleotide
tgccactcctgatgttctgcctggg

SEQ ID NO: 724211 - DNA, 25 bp, Artificial sequence
  Synthetic oligonucleotide
taaccttgccactcctgatgttctg

SEQ ID NO: 724212 - DNA, 25 bp, Artificial sequence
  Synthetic oligonucleotide
gttccgtaaccttgccactcctgat

SEQ ID NO: 724213 - DNA, 25 bp, Artificial sequence
  Synthetic oligonucleotide
cccatgcgttccgtaaccttgccac

SEQ ID NO: 724214 - DNA, 25 bp, Artificial sequence
  Synthetic oligonucleotide
aggtgccccatgcgttccgtaacct

SEQ ID NO: 724215 - DNA, 25 bp, Artificial sequence
  Synthetic oligonucleotide
aaaaggaggtgccccatgcgttccg

SEQ ID NO: 724216 - DNA, 25 bp, Artificial sequence
  Synthetic oligonucleotide
cgacgaaaaaaggaggtgccccatg

SEQ ID NO: 724217 - DNA, 25 bp, Artificial sequence
  Synthetic oligonucleotide
tgaggacgacgaaaaaaggaggtgc

SEQ ID NO: 724218 - DNA, 25 bp, Artificial sequence
  Synthetic oligonucleotide
gtcacacctttgaggacgacgaaaa

SEQ ID NO: 724219 - DNA, 25 bp, Artificial sequence
  Synthetic oligonucleotide
tcgggggtcacacctttgaggacga

SEQ ID NO: 724220 - DNA, 25 bp, Artificial sequence
  Synthetic oligonucleotide
cgtcctcgggggtcacacctttgag

SEQ ID NO: 724221 - DNA, 25 bp, Artificial sequence
  Synthetic oligonucleotide
ccattcgccgtcctcgggggtcaca

SEQ ID NO: 724222 - DNA, 25 bp, Artificial sequence
  Synthetic oligonucleotide
tgttctgcctgggcctggccgcctg

SEQ ID NO: 724223 - DNA, 25 bp, Artificial sequence
  Synthetic oligonucleotide
gtcctgccggccgtggaaatcctgg

SEQ ID NO: 724224 - DNA, 25 bp, Artificial sequence
  Synthetic oligonucleotide
acaccttcctcgccgcggccggaca

SEQ ID NO: 724225 - DNA, 25 bp, Artificial sequence
  Synthetic oligonucleotide
ggtggcggcgcgttcctcgagttcg

SEQ ID NO: 724226 - DNA, 25 bp, Artificial sequence
  Synthetic oligonucleotide
ggcgcgttcctcgagttcgtcgagg

SEQ ID NO: 724227 - DNA, 25 bp, Artificial sequence
  Synthetic oligonucleotide
tcctcgagttcgtcgagggcaaggt

SEQ ID NO: 724228 - DNA, 25 bp, Artificial sequence
  Synthetic oligonucleotide
agttcgtcgagggcaaggtcctgcc

SEQ ID NO: 724229 - DNA, 25 bp, Artificial sequence
  Synthetic oligonucleotide
cagacggggcaaaccattcgccgtc

SEQ ID NO: 724230 - DNA, 25 bp, Artificial sequence
  Synthetic oligonucleotide
gcaaggtcctgccggccgtggaaat

SEQ ID NO: 724231 - DNA, 25 bp, Artificial sequence
  Synthetic oligonucleotide
tgacgcagacggggcaaaccattcg

SEQ ID NO: 724232 - DNA, 25 bp, Artificial sequence
  Synthetic oligonucleotide
ccggccgtggaaatcctggagcagc

SEQ ID NO: 724233 - DNA, 25 bp, Artificial sequence
  Synthetic oligonucleotide
gtggaaatcctggagcagcgcgcca

SEQ ID NO: 724234 - DNA, 25 bp, Artificial sequence
  Synthetic oligonucleotide
aatcctggagcagcgcgccaagggc

SEQ ID NO: 724235 - DNA, 25 bp, Artificial sequence
  Synthetic oligonucleotide
ggagcagcgcgccaagggctgacgc

SEQ ID NO: 724236 - DNA, 25 bp, Artificial sequence
  Synthetic oligonucleotide
cgcgccaagggctgacgcagacggg

SEQ ID NO: 724237 - DNA, 25 bp, Artificial sequence
  Synthetic oligonucleotide
gcctgggcctggccgcctgtagcgg

SEQ ID NO: 724238 - DNA, 25 bp, Artificial sequence
  Synthetic oligonucleotide
tcgagggcaaggtcctgccggccgt

SEQ ID NO: 724239 - DNA, 25 bp, Artificial sequence
  Synthetic oligonucleotide
cgaccgagcagaaccgccagcgggt

SEQ ID NO: 724240 - DNA, 25 bp, Artificial sequence
  Synthetic oligonucleotide
tctacggaaagggctggggattcgc

SEQ ID NO: 724241 - DNA, 25 bp, Artificial sequence
  Synthetic oligonucleotide
ttctgccagtttctacggaaagggc

SEQ ID NO: 724242 - DNA, 25 bp, Artificial sequence
  Synthetic oligonucleotide
gtgcttttctgccagtttctacgga

SEQ ID NO: 724243 - DNA, 25 bp, Artificial sequence
  Synthetic oligonucleotide
gcccgtagtgcttttctgccagttt

SEQ ID NO: 724244 - DNA, 25 bp, Artificial sequence
  Synthetic oligonucleotide
tggaatgcccgtagtgcttttctgc

SEQ ID NO: 724245 - DNA, 25 bp, Artificial sequence
  Synthetic oligonucleotide
agccggtggaatgcccgtagtgctt

SEQ ID NO: 724246 - DNA, 25 bp, Artificial sequence
  Synthetic oligonucleotide
gacaaaagccggtggaatgcccgta

SEQ ID NO: 724247 - DNA, 25 bp, Artificial sequence
  Synthetic oligonucleotide
ccgccggacaaaagccggtggaatg

SEQ ID NO: 724248 - DNA, 25 bp, Artificial sequence
  Synthetic oligonucleotide
cgatccgaccgccggacaaaagccg

SEQ ID NO: 724249 - DNA, 25 bp, Artificial sequence
  Synthetic oligonucleotide
cagcggcgatccgaccgccggacaa

SEQ ID NO: 724250 - DNA, 25 bp, Artificial sequence
  Synthetic oligonucleotide
agcagagcagcggcgatccgaccgc

SEQ ID NO: 724251 - DNA, 25 bp, Artificial sequence
  Synthetic oligonucleotide
tcgagcagcagagcagcggcgatcc

SEQ ID NO: 724252 - DNA, 25 bp, Artificial sequence
  Synthetic oligonucleotide
agcgggtcgagcagcagagcagcgg

SEQ ID NO: 724253 - DNA, 25 bp, Artificial sequence
  Synthetic oligonucleotide
tcctgatgttctgcctgggcctggc

SEQ ID NO: 724254 - DNA, 25 bp, Artificial sequence
  Synthetic oligonucleotide
acctgcgaggtgatcagtccgccgg

SEQ ID NO: 724255 - DNA, 25 bp, Artificial sequence
  Synthetic oligonucleotide
gcctggccgcctgtagcggcgatgg

SEQ ID NO: 724256 - DNA, 25 bp, Artificial sequence
  Synthetic oligonucleotide
ccgcctgtagcggcgatggcggtcg

SEQ ID NO: 724257 - DNA, 25 bp, Artificial sequence
  Synthetic oligonucleotide
tgtagcggcgatggcggtcgacgcc

SEQ ID NO: 724258 - DNA, 25 bp, Artificial sequence
  Synthetic oligonucleotide
ggcgatggcggtcgacgcccgagca

SEQ ID NO: 724259 - DNA, 25 bp, Artificial sequence
  Synthetic oligonucleotide
ggcggtcgacgcccgagcacctgcg

SEQ ID NO: 724260 - DNA, 25 bp, Artificial sequence
  Synthetic oligonucleotide
accgccagcgggtcgagcagcagag

SEQ ID NO: 724261 - DNA, 25 bp, Artificial sequence
  Synthetic oligonucleotide
ccgagcacctgcgaggtgatcagtc

SEQ ID NO: 724262 - DNA, 25 bp, Artificial sequence
  Synthetic oligonucleotide
agcagaaccgccagcgggtcgagca

SEQ ID NO: 724263 - DNA, 25 bp, Artificial sequence
  Synthetic oligonucleotide
gaggtgatcagtccgccggacgtga

SEQ ID NO: 724264 - DNA, 25 bp, Artificial sequence
  Synthetic oligonucleotide
atcagtccgccggacgtgatggtgc

SEQ ID NO: 724265 - DNA, 25 bp, Artificial sequence
  Synthetic oligonucleotide
ccgccggacgtgatggtgccgaccg

SEQ ID NO: 724266 - DNA, 25 bp, Artificial sequence
  Synthetic oligonucleotide
gacgtgatggtgccgaccgagcaga

SEQ ID NO: 724267 - DNA, 25 bp, Artificial sequence
  Synthetic oligonucleotide
atggtgccgaccgagcagaaccgcc

SEQ ID NO: 724268 - DNA, 25 bp, Artificial sequence
  Synthetic oligonucleotide
atctcctatatttccaccggtggcg

SEQ ID NO: 724269 - DNA, 25 bp, Artificial sequence
  Synthetic oligonucleotide
cgacgcccgagcacctgcgaggtga

SEQ ID NO: 724270 - DNA, 25 bp, Artificial sequence
  Synthetic oligonucleotide
tggacgtggtggtggccaaggaatt

SEQ ID NO: 724271 - DNA, 25 bp, Artificial sequence
  Synthetic oligonucleotide
tccaccggtggcggcgcgttcctcg

SEQ ID NO: 724272 - DNA, 25 bp, Artificial sequence
  Synthetic oligonucleotide
tcctcgacatcggcccgcagaccgc

SEQ ID NO: 724273 - DNA, 25 bp, Artificial sequence
  Synthetic oligonucleotide
acatgatcctcgacatcggcccgca

SEQ ID NO: 724274 - DNA, 25 bp, Artificial sequence
  Synthetic oligonucleotide
acgacgacatgatcctcgacatcgg

SEQ ID NO: 724275 - DNA, 25 bp, Artificial sequence
  Synthetic oligonucleotide
tcgccgacgacgacatgatcctcga

SEQ ID NO: 724276 - DNA, 25 bp, Artificial sequence
  Synthetic oligonucleotide
ccgaggtcgccgacgacgacatgat

SEQ ID NO: 724277 - DNA, 25 bp, Artificial sequence
  Synthetic oligonucleotide
ccatcgccgaggtcgccgacgacga

SEQ ID NO: 724278 - DNA, 25 bp, Artificial sequence
  Synthetic oligonucleotide
tcaaggccatcgccgaggtcgccga

SEQ ID NO: 724279 - DNA, 25 bp, Artificial sequence
  Synthetic oligonucleotide
gaccgtcaaggccatcgccgaggtc

SEQ ID NO: 724280 - DNA, 25 bp, Artificial sequence
  Synthetic oligonucleotide
ccgtggcgaccgtcaaggccatcgc

SEQ ID NO: 724281 - DNA, 25 bp, Artificial sequence
  Synthetic oligonucleotide
agagcgccgtggcgaccgtcaaggc

SEQ ID NO: 724282 - DNA, 25 bp, Artificial sequence
  Synthetic oligonucleotide
tcgccgagagcgccgtggcgaccgt

SEQ ID NO: 724283 - DNA, 25 bp, Artificial sequence
  Synthetic oligonucleotide
aggaattcgccgagagcgccgtggc

SEQ ID NO: 724284 - DNA, 25 bp, Artificial sequence
  Synthetic oligonucleotide
cccgcagaccgccgcgcagttcgcc

SEQ ID NO: 724285 - DNA, 25 bp, Artificial sequence
  Synthetic oligonucleotide
aggccatcgccgccaaggtcaaggt

SEQ ID NO: 724286 - DNA, 25 bp, Artificial sequence
  Synthetic oligonucleotide
tcggcaagtcactgtacgaggccga

SEQ ID NO: 724287 - DNA, 25 bp, Artificial sequence
  Synthetic oligonucleotide
agtcactgtacgaggccgacctggt

SEQ ID NO: 724288 - DNA, 25 bp, Artificial sequence
  Synthetic oligonucleotide
tgtacgaggccgacctggtcgagac

SEQ ID NO: 724289 - DNA, 25 bp, Artificial sequence
  Synthetic oligonucleotide
aggccgacctggtcgagaccgccaa

SEQ ID NO: 724290 - DNA, 25 bp, Artificial sequence
  Synthetic oligonucleotide
acctggtcgagaccgccaaggccat

SEQ ID NO: 724291 - DNA, 25 bp, Artificial sequence
  Synthetic oligonucleotide
tggccaaggaattcgccgagagcgc

SEQ ID NO: 724292 - DNA, 25 bp, Artificial sequence
  Synthetic oligonucleotide
ccgccaaggccatcgccgccaaggt

SEQ ID NO: 724293 - DNA, 25 bp, Artificial sequence
  Synthetic oligonucleotide
tggtggtggccaaggaattcgccga

SEQ ID NO: 724294 - DNA, 25 bp, Artificial sequence
  Synthetic oligonucleotide
tcgccgccaaggtcaaggtgccgct

SEQ ID NO: 724295 - DNA, 25 bp, Artificial sequence
  Synthetic oligonucleotide
ccaaggtcaaggtgccgctgccggt

SEQ ID NO: 724296 - DNA, 25 bp, Artificial sequence
  Synthetic oligonucleotide
tcaaggtgccgctgccggtggacgt

SEQ ID NO: 724297 - DNA, 25 bp, Artificial sequence
  Synthetic oligonucleotide
tgccgctgccggtggacgtggtggt

SEQ ID NO: 724298 - DNA, 25 bp, Artificial sequence
  Synthetic oligonucleotide
tgccggtggacgtggtggtggccaa

SEQ ID NO: 724299 - DNA, 25 bp, Artificial sequence
  Synthetic oligonucleotide
gaccgccgcgcagttcgccgagctg

SEQ ID NO: 724300 - DNA, 25 bp, Artificial sequence
  Synthetic oligonucleotide
tcgagaccgccaaggccatcgccgc

SEQ ID NO: 724301 - DNA, 25 bp, Artificial sequence
  Synthetic oligonucleotide
accctggccaatgccatcgccgata

SEQ ID NO: 724302 - DNA, 25 bp, Artificial sequence
  Synthetic oligonucleotide
gagcggatctcctatatttccaccg

SEQ ID NO: 724303 - DNA, 25 bp, Artificial sequence
  Synthetic oligonucleotide
atcgccgagcggatctcctatattt

SEQ ID NO: 724304 - DNA, 25 bp, Artificial sequence
  Synthetic oligonucleotide
tacggcatcgccgagcggatctcct

SEQ ID NO: 724305 - DNA, 25 bp, Artificial sequence
  Synthetic oligonucleotide
gacaagtacggcatcgccgagcgga

SEQ ID NO: 724306 - DNA, 25 bp, Artificial sequence
  Synthetic oligonucleotide
gcgatcgacaagtacggcatcgccg

SEQ ID NO: 724307 - DNA, 25 bp, Artificial sequence
  Synthetic oligonucleotide
ctggcggcgatcgacaagtacggca

SEQ ID NO: 724308 - DNA, 25 bp, Artificial sequence
  Synthetic oligonucleotide
cgataccctggcggcgatcgacaag

SEQ ID NO: 724309 - DNA, 25 bp, Artificial sequence
  Synthetic oligonucleotide
gcggcggcgataccctggcggcgat

SEQ ID NO: 724310 - DNA, 25 bp, Artificial sequence
  Synthetic oligonucleotide
tcgccggcggcggcgataccctggc

SEQ ID NO: 724311 - DNA, 25 bp, Artificial sequence
  Synthetic oligonucleotide
tctccatcgccggcggcggcgatac

SEQ ID NO: 724312 - DNA, 25 bp, Artificial sequence
  Synthetic oligonucleotide
cggcgttctccatcgccggcggcgg

SEQ ID NO: 724313 - DNA, 25 bp, Artificial sequence
  Synthetic oligonucleotide
atagcgcggcgttctccatcgccgg

SEQ ID NO: 724314 - DNA, 25 bp, Artificial sequence
  Synthetic oligonucleotide
cgccgatagcgcggcgttctccatc

SEQ ID NO: 724315 - DNA, 25 bp, Artificial sequence
  Synthetic oligonucleotide
acatcggcccgcagaccgccgcgca

SEQ ID NO: 724316 - DNA, 25 bp, Artificial sequence
  Synthetic oligonucleotide
ggtgttcgagttcgaccagttcggc

SEQ ID NO: 724317 - DNA, 25 bp, Artificial sequence
  Synthetic oligonucleotide
gcgcagttcgccgagctgctgaaga

SEQ ID NO: 724318 - DNA, 25 bp, Artificial sequence
  Synthetic oligonucleotide
ttcgccgagctgctgaagacctcga

SEQ ID NO: 724319 - DNA, 25 bp, Artificial sequence
  Synthetic oligonucleotide
gagctgctgaagacctcgaagacca

SEQ ID NO: 724320 - DNA, 25 bp, Artificial sequence
  Synthetic oligonucleotide
ctgaagacctcgaagaccatcctgt

SEQ ID NO: 724321 - DNA, 25 bp, Artificial sequence
  Synthetic oligonucleotide
acctcgaagaccatcctgtggaacg

SEQ ID NO: 724322 - DNA, 25 bp, Artificial sequence
  Synthetic oligonucleotide
tgccatcgccgatagcgcggcgttc

SEQ ID NO: 724323 - DNA, 25 bp, Artificial sequence
  Synthetic oligonucleotide
catcctgtggaacggtccggtcggg

SEQ ID NO: 724324 - DNA, 25 bp, Artificial sequence
  Synthetic oligonucleotide
ggccaatgccatcgccgatagcgcg

SEQ ID NO: 724325 - DNA, 25 bp, Artificial sequence
  Synthetic oligonucleotide
cgagttcgaccagttcggcgagggc

SEQ ID NO: 724326 - DNA, 25 bp, Artificial sequence
  Synthetic oligonucleotide
gaccagttcggcgagggcacccgta

SEQ ID NO: 724327 - DNA, 25 bp, Artificial sequence
  Synthetic oligonucleotide
tcggcgagggcacccgtaccctggc

SEQ ID NO: 724328 - DNA, 25 bp, Artificial sequence
  Synthetic oligonucleotide
gagggcacccgtaccctggccaatg

SEQ ID NO: 724329 - DNA, 25 bp, Artificial sequence
  Synthetic oligonucleotide
acccgtaccctggccaatgccatcg

SEQ ID NO: 724330 - DNA, 25 bp, Artificial sequence
  Synthetic oligonucleotide
aaagggctggggattcgccagcgta

SEQ ID NO: 724331 - DNA, 25 bp, Artificial sequence
  Synthetic oligonucleotide
aagaccatcctgtggaacggtccgg

SEQ ID NO: 724332 - DNA, 25 bp, Artificial sequence
  Synthetic oligonucleotide
agcctctaccgtaggcaatgcattg

SEQ ID NO: 724333 - DNA, 25 bp, Artificial sequence
  Synthetic oligonucleotide
ggaggtgtttccaagacccaagcac

SEQ ID NO: 724334 - DNA, 25 bp, Artificial sequence
  Synthetic oligonucleotide
aggcaatgcattggggttcttggga

SEQ ID NO: 724335 - DNA, 25 bp, Artificial sequence
  Synthetic oligonucleotide
tgcattggggttcttgggaggtgtt

SEQ ID NO: 724336 - DNA, 25 bp, Artificial sequence
  Synthetic oligonucleotide
tcttgggaggtgtttccaagaccca

SEQ ID NO: 724337 - DNA, 25 bp, Artificial sequence
  Synthetic oligonucleotide
taccgtaggcaatgcattggggttc

SEQ ID NO: 724338 - DNA, 25 bp, Artificial sequence
  Synthetic oligonucleotide
gtttccaagacccaagcacccatgg

SEQ ID NO: 724339 - DNA, 25 bp, Artificial sequence
  Synthetic oligonucleotide
aagacccaagcacccatggccctgg

SEQ ID NO: 724340 - DNA, 25 bp, Artificial sequence
  Synthetic oligonucleotide
caagcacccatggccctggatatgg

SEQ ID NO: 724341 - DNA, 25 bp, Artificial sequence
  Synthetic oligonucleotide
cccatggccctggatatggacacgg

SEQ ID NO: 724342 - DNA, 25 bp, Artificial sequence
  Synthetic oligonucleotide
gatatggacacggtgaacgaaagcg

SEQ ID NO: 724343 - DNA, 25 bp, Artificial sequence
  Synthetic oligonucleotide
caatggagcctctaccgtaggcaat

SEQ ID NO: 724344 - DNA, 25 bp, Artificial sequence
  Synthetic oligonucleotide
agtgaagccttgggcgatagcgtct

SEQ ID NO: 724345 - DNA, 25 bp, Artificial sequence
  Synthetic oligonucleotide
gccctggatatggacacggtgaacg

SEQ ID NO: 724346 - DNA, 25 bp, Artificial sequence
  Synthetic oligonucleotide
tgctatcaatggagcctctaccgta

SEQ ID NO: 724347 - DNA, 25 bp, Artificial sequence
  Synthetic oligonucleotide
tggccgtgctatcaatggagcctct

SEQ ID NO: 724348 - DNA, 25 bp, Artificial sequence
  Synthetic oligonucleotide
cgaagttggccgtgctatcaatgga

SEQ ID NO: 724349 - DNA, 25 bp, Artificial sequence
  Synthetic oligonucleotide
gatcaccgaagttggccgtgctatc

SEQ ID NO: 724350 - DNA, 25 bp, Artificial sequence
  Synthetic oligonucleotide
catggggatcaccgaagttggccgt

SEQ ID NO: 724351 - DNA, 25 bp, Artificial sequence
  Synthetic oligonucleotide
ggctgacatggggatcaccgaagtt

SEQ ID NO: 724352 - DNA, 25 bp, Artificial sequence
  Synthetic oligonucleotide
aggcgcaggctgacatggggatcac

SEQ ID NO: 724353 - DNA, 25 bp, Artificial sequence
  Synthetic oligonucleotide
gttcgcaggcgcaggctgacatggg

SEQ ID NO: 724354 - DNA, 25 bp, Artificial sequence
  Synthetic oligonucleotide
ctaccggttcgcaggcgcaggctga

SEQ ID NO: 724355 - DNA, 25 bp, Artificial sequence
  Synthetic oligonucleotide
tagcgtctaccggttcgcaggcgca

SEQ ID NO: 724356 - DNA, 25 bp, Artificial sequence
  Synthetic oligonucleotide
gacacggtgaacgaaagcggatggt

SEQ ID NO: 724357 - DNA, 25 bp, Artificial sequence
  Synthetic oligonucleotide
gccttgggcgatagcgtctaccggt

SEQ ID NO: 724358 - DNA, 25 bp, Artificial sequence
  Synthetic oligonucleotide
tgaacggccatgtcgctctgtcgat

SEQ ID NO: 724359 - DNA, 25 bp, Artificial sequence
  Synthetic oligonucleotide
ggcgatagcgtctaccggttcgcag

SEQ ID NO: 724360 - DNA, 25 bp, Artificial sequence
  Synthetic oligonucleotide
gccatgtcgctctgtcgatggtatt

SEQ ID NO: 724361 - DNA, 25 bp, Artificial sequence
  Synthetic oligonucleotide
aggagctgtaccaatggaacctgga

SEQ ID NO: 724362 - DNA, 25 bp, Artificial sequence
  Synthetic oligonucleotide
tggtacaggagctgtaccaatggaa

SEQ ID NO: 724363 - DNA, 25 bp, Artificial sequence
  Synthetic oligonucleotide
gaggtttggtacaggagctgtacca

SEQ ID NO: 724364 - DNA, 25 bp, Artificial sequence
  Synthetic oligonucleotide
ctcccggaggtttggtacaggagct

SEQ ID NO: 724365 - DNA, 25 bp, Artificial sequence
  Synthetic oligonucleotide
tgtgagaaataccaacctcccggag

SEQ ID NO: 724366 - DNA, 25 bp, Artificial sequence
  Synthetic oligonucleotide
ttctttgtgagaaataccaacctcc

SEQ ID NO: 724367 - DNA, 25 bp, Artificial sequence
  Synthetic oligonucleotide
cagctgttctttgtgagaaatacca

SEQ ID NO: 724368 - DNA, 25 bp, Artificial sequence
  Synthetic oligonucleotide
cgctatcagctgttctttgtgagaa

SEQ ID NO: 724369 - DNA, 25 bp, Artificial sequence
  Synthetic oligonucleotide
agtacccgctatcagctgttctttg

SEQ ID NO: 724370 - DNA, 25 bp, Artificial sequence
  Synthetic oligonucleotide
gacgccagtacccgctatcagctgt

SEQ ID NO: 724371 - DNA, 25 bp, Artificial sequence
  Synthetic oligonucleotide
ggtattcgacgccagtacccgctat

SEQ ID NO: 724372 - DNA, 25 bp, Artificial sequence
  Synthetic oligonucleotide
atatcagcggtgtgaacggccatgt

SEQ ID NO: 724373 - DNA, 25 bp, Artificial sequence
  Synthetic oligonucleotide
tcgctctgtcgatggtattcgacgc

SEQ ID NO: 724374 - DNA, 25 bp, Artificial sequence
  Synthetic oligonucleotide
tgaacgaaagcggatggttctcgat

SEQ ID NO: 724375 - DNA, 25 bp, Artificial sequence
  Synthetic oligonucleotide
atcaccccggtgcaggggtactcga

SEQ ID NO: 724376 - DNA, 25 bp, Artificial sequence
  Synthetic oligonucleotide
gcggtgtgaacggccatgtcgctct

SEQ ID NO: 724377 - DNA, 25 bp, Artificial sequence
  Synthetic oligonucleotide
ggcggcagtgaagccttgggcgata

SEQ ID NO: 724378 - DNA, 25 bp, Artificial sequence
  Synthetic oligonucleotide
acaacaatatcagcggtgtgaacgg

SEQ ID NO: 724379 - DNA, 25 bp, Artificial sequence
  Synthetic oligonucleotide
ttggaaacaacaatatcagcggtgt

SEQ ID NO: 724380 - DNA, 25 bp, Artificial sequence
  Synthetic oligonucleotide
tgcctcttggaaacaacaatatcag

SEQ ID NO: 724381 - DNA, 25 bp, Artificial sequence
  Synthetic oligonucleotide
acaacgtgcctcttggaaacaacaa

SEQ ID NO: 724382 - DNA, 25 bp, Artificial sequence
  Synthetic oligonucleotide
atacttacaacgtgcctcttggaaa

SEQ ID NO: 724383 - DNA, 25 bp, Artificial sequence
  Synthetic oligonucleotide
cccccaatacttacaacgtgcctct

SEQ ID NO: 724384 - DNA, 25 bp, Artificial sequence
  Synthetic oligonucleotide
ttctcgataacccccaatacttaca

SEQ ID NO: 724385 - DNA, 25 bp, Artificial sequence
  Synthetic oligonucleotide
ggatggttctcgataacccccaata

SEQ ID NO: 724386 - DNA, 25 bp, Artificial sequence
  Synthetic oligonucleotide
gaaagcggatggttctcgataaccc

SEQ ID NO: 724387 - DNA, 25 bp, Artificial sequence
  Synthetic oligonucleotide
tgtcgatggtattcgacgccagtac

SEQ ID NO: 724388 - DNA, 25 bp, Artificial sequence
  Synthetic oligonucleotide
cacaggcacggtttccgtcgtcctt

SEQ ID NO: 724389 - DNA, 25 bp, Artificial sequence
  Synthetic oligonucleotide
tcagagggccggatggccgctggta

SEQ ID NO: 724390 - DNA, 25 bp, Artificial sequence
  Synthetic oligonucleotide
atgccttcagagggccggatggccg

SEQ ID NO: 724391 - DNA, 25 bp, Artificial sequence
  Synthetic oligonucleotide
ccggcgatgccttcagagggccgga

SEQ ID NO: 724392 - DNA, 25 bp, Artificial sequence
  Synthetic oligonucleotide
cgcgcgccggcgatgccttcagagg

SEQ ID NO: 724393 - DNA, 25 bp, Artificial sequence
  Synthetic oligonucleotide
gccaatgcgcgcgccggcgatgcct

SEQ ID NO: 724394 - DNA, 25 bp, Artificial sequence
  Synthetic oligonucleotide
ttcagcgccaatgcgcgcgccggcg

SEQ ID NO: 724395 - DNA, 25 bp, Artificial sequence
  Synthetic oligonucleotide
accgccttcagcgccaatgcgcgcg

SEQ ID NO: 724396 - DNA, 25 bp, Artificial sequence
  Synthetic oligonucleotide
agcggcaccgccttcagcgccaatg

SEQ ID NO: 724397 - DNA, 25 bp, Artificial sequence
  Synthetic oligonucleotide
accggcagcggcaccgccttcagcg

SEQ ID NO: 724398 - DNA, 25 bp, Artificial sequence
  Synthetic oligonucleotide
acggtgaccggcagcggcaccgcct

SEQ ID NO: 724399 - DNA, 25 bp, Artificial sequence
  Synthetic oligonucleotide
tcggacacggtgaccggcagcggca

SEQ ID NO: 724400 - DNA, 25 bp, Artificial sequence
  Synthetic oligonucleotide
caggggtactcgaagacactggcgg

SEQ ID NO: 724401 - DNA, 25 bp, Artificial sequence
  Synthetic oligonucleotide
cgtcgtccttaattcggacacggtg

SEQ ID NO: 724402 - DNA, 25 bp, Artificial sequence
  Synthetic oligonucleotide
gctggtacgagatcggcaacgttgc

SEQ ID NO: 724403 - DNA, 25 bp, Artificial sequence
  Synthetic oligonucleotide
gtattccacaggcacggtttccgtc

SEQ ID NO: 724404 - DNA, 25 bp, Artificial sequence
  Synthetic oligonucleotide
gccttggtattccacaggcacggtt

SEQ ID NO: 724405 - DNA, 25 bp, Artificial sequence
  Synthetic oligonucleotide
cgtcatgccttggtattccacaggc

SEQ ID NO: 724406 - DNA, 25 bp, Artificial sequence
  Synthetic oligonucleotide
ggagaacgtcatgccttggtattcc

SEQ ID NO: 724407 - DNA, 25 bp, Artificial sequence
  Synthetic oligonucleotide
ttatctggagaacgtcatgccttgg

SEQ ID NO: 724408 - DNA, 25 bp, Artificial sequence
  Synthetic oligonucleotide
ttttcattatctggagaacgtcatg

SEQ ID NO: 724409 - DNA, 25 bp, Artificial sequence
  Synthetic oligonucleotide
gcgggtttttcattatctggagaac

SEQ ID NO: 724410 - DNA, 25 bp, Artificial sequence
  Synthetic oligonucleotide
ccgactgcgggtttttcattatctg

SEQ ID NO: 724411 - DNA, 25 bp, Artificial sequence
  Synthetic oligonucleotide
agcccgccgactgcgggtttttcat

SEQ ID NO: 724412 - DNA, 25 bp, Artificial sequence
  Synthetic oligonucleotide
ctatcaagcccgccgactgcgggtt

SEQ ID NO: 724413 - DNA, 25 bp, Artificial sequence
  Synthetic oligonucleotide
actaaccctatcaagcccgccgact

SEQ ID NO: 724414 - DNA, 25 bp, Artificial sequence
  Synthetic oligonucleotide
tccgaactaaccctatcaagcccgc

SEQ ID NO: 724415 - DNA, 25 bp, Artificial sequence
  Synthetic oligonucleotide
cttaattcggacacggtgaccggca

SEQ ID NO: 724416 - DNA, 25 bp, Artificial sequence
  Synthetic oligonucleotide
caacggccaggcatattcgatcacc

SEQ ID NO: 724417 - DNA, 25 bp, Artificial sequence
  Synthetic oligonucleotide
ggttccctcctggcggcagtgaagc

SEQ ID NO: 724418 - DNA, 25 bp, Artificial sequence
  Synthetic oligonucleotide
aatggggttccctcctggcggcagt

SEQ ID NO: 724419 - DNA, 25 bp, Artificial sequence
  Synthetic oligonucleotide
agcaatcaatggggttccctcctgg

SEQ ID NO: 724420 - DNA, 25 bp, Artificial sequence
  Synthetic oligonucleotide
gacctcagcaatcaatggggttccc

SEQ ID NO: 724421 - DNA, 25 bp, Artificial sequence
  Synthetic oligonucleotide
ttccgtgacctcagcaatcaatggg

SEQ ID NO: 724422 - DNA, 25 bp, Artificial sequence
  Synthetic oligonucleotide
gatcagttccgtgacctcagcaatc

SEQ ID NO: 724423 - DNA, 25 bp, Artificial sequence
  Synthetic oligonucleotide
ctggcggatcagttccgtgacctca

SEQ ID NO: 724424 - DNA, 25 bp, Artificial sequence
  Synthetic oligonucleotide
aagacactggcggatcagttccgtg

SEQ ID NO: 724425 - DNA, 25 bp, Artificial sequence
  Synthetic oligonucleotide
tactcgaagacactggcggatcagt

SEQ ID NO: 724426 - DNA, 25 bp, Artificial sequence
  Synthetic oligonucleotide
tgtaccaatggaacctggaaggagt

SEQ ID NO: 724427 - DNA, 25 bp, Artificial sequence
  Synthetic oligonucleotide
ccggtgcaggggtactcgaagacac

SEQ ID NO: 724428 - DNA, 25 bp, Artificial sequence
  Synthetic oligonucleotide
cacaggtaagcccaccggggccgtg

SEQ ID NO: 724429 - DNA, 25 bp, Artificial sequence
  Synthetic oligonucleotide
ggccggatggccgctggtacgagat

SEQ ID NO: 724430 - DNA, 25 bp, Artificial sequence
  Synthetic oligonucleotide
caggcatattcgatcaccccggtgc

SEQ ID NO: 724431 - DNA, 25 bp, Artificial sequence
  Synthetic oligonucleotide
atggccgctggtacgagatcggcaa

SEQ ID NO: 724432 - DNA, 25 bp, Artificial sequence
  Synthetic oligonucleotide
taccgccaacggccaggcatattcg

SEQ ID NO: 724433 - DNA, 25 bp, Artificial sequence
  Synthetic oligonucleotide
aaggagctaccgccaacggccaggc

SEQ ID NO: 724434 - DNA, 25 bp, Artificial sequence
  Synthetic oligonucleotide
catatcaaggagctaccgccaacgg

SEQ ID NO: 724435 - DNA, 25 bp, Artificial sequence
  Synthetic oligonucleotide
agcccgcatatcaaggagctaccgc

SEQ ID NO: 724436 - DNA, 25 bp, Artificial sequence
  Synthetic oligonucleotide
ccatcaagcccgcatatcaaggagc

SEQ ID NO: 724437 - DNA, 25 bp, Artificial sequence
  Synthetic oligonucleotide
tgctgaccatcaagcccgcatatca

SEQ ID NO: 724438 - DNA, 25 bp, Artificial sequence
  Synthetic oligonucleotide
ccactgtgctgaccatcaagcccgc

SEQ ID NO: 724439 - DNA, 25 bp, Artificial sequence
  Synthetic oligonucleotide
ccagcgccactgtgctgaccatcaa

SEQ ID NO: 724440 - DNA, 25 bp, Artificial sequence
  Synthetic oligonucleotide
acgttgccagcgccactgtgctgac

SEQ ID NO: 724441 - DNA, 25 bp, Artificial sequence
  Synthetic oligonucleotide
tcggcaacgttgccagcgccactgt

SEQ ID NO: 724442 - DNA, 25 bp, Artificial sequence
  Synthetic oligonucleotide
acgagatcggcaacgttgccagcgc

SEQ ID NO: 724443 - DNA, 25 bp, Artificial sequence
  Synthetic oligonucleotide
cctcctggcggcagtgaagccttgg

SEQ ID NO: 724444 - DNA, 25 bp, Artificial sequence
  Synthetic oligonucleotide
tattcgatcaccccggtgcaggggt

SEQ ID NO: 724445 - DNA, 25 bp, Artificial sequence
  Synthetic oligonucleotide
tgatatggatgtcatggtttccgga

SEQ ID NO: 724446 - DNA, 25 bp, Artificial sequence
  Synthetic oligonucleotide
aggcgacttgtcacaggtaagccca

SEQ ID NO: 724447 - DNA, 25 bp, Artificial sequence
  Synthetic oligonucleotide
gggggatatctgcccgcctctgcca

SEQ ID NO: 724448 - DNA, 25 bp, Artificial sequence
  Synthetic oligonucleotide
ccggaggggggatatctgcccgcct

SEQ ID NO: 724449 - DNA, 25 bp, Artificial sequence
  Synthetic oligonucleotide
cagttaccggaggggggatatctgc

SEQ ID NO: 724450 - DNA, 25 bp, Artificial sequence
  Synthetic oligonucleotide
tctcgcagttaccggaggggggata

SEQ ID NO: 724451 - DNA, 25 bp, Artificial sequence
  Synthetic oligonucleotide
tgtacgacttctcgcagttaccgga

SEQ ID NO: 724452 - DNA, 25 bp, Artificial sequence
  Synthetic oligonucleotide
gtgtcatgtacgacttctcgcagtt

SEQ ID NO: 724453 - DNA, 25 bp, Artificial sequence
  Synthetic oligonucleotide
tctcgggtgtcatgtacgacttctc

SEQ ID NO: 724454 - DNA, 25 bp, Artificial sequence
  Synthetic oligonucleotide
tagccgtctcgggtgtcatgtacga

SEQ ID NO: 724455 - DNA, 25 bp, Artificial sequence
  Synthetic oligonucleotide
gattcgatagccgtctcgggtgtca

SEQ ID NO: 724456 - DNA, 25 bp, Artificial sequence
  Synthetic oligonucleotide
ttccggagattcgatagccgtctcg

SEQ ID NO: 724457 - DNA, 25 bp, Artificial sequence
  Synthetic oligonucleotide
cccgcctctgccatccatgaggggc

SEQ ID NO: 724458 - DNA, 25 bp, Artificial sequence
  Synthetic oligonucleotide
ggatgtcatggtttccggagattcg

SEQ ID NO: 724459 - DNA, 25 bp, Artificial sequence
  Synthetic oligonucleotide
tctgccatccatgaggggccttttt

SEQ ID NO: 724460 - DNA, 25 bp, Artificial sequence
  Synthetic oligonucleotide
ctcgactgatatggatgtcatggtt

SEQ ID NO: 724461 - DNA, 25 bp, Artificial sequence
  Synthetic oligonucleotide
cgaggactcgactgatatggatgtc

SEQ ID NO: 724462 - DNA, 25 bp, Artificial sequence
  Synthetic oligonucleotide
cctgcccgaggactcgactgatatg

SEQ ID NO: 724463 - DNA, 25 bp, Artificial sequence
  Synthetic oligonucleotide
ttgtagtcctgcccgaggactcgac

SEQ ID NO: 724464 - DNA, 25 bp, Artificial sequence
  Synthetic oligonucleotide
gtccggttgtagtcctgcccgagga

SEQ ID NO: 724465 - DNA, 25 bp, Artificial sequence
  Synthetic oligonucleotide
aactcagtccggttgtagtcctgcc

SEQ ID NO: 724466 - DNA, 25 bp, Artificial sequence
  Synthetic oligonucleotide
gtatcgaactcagtccggttgtagt

SEQ ID NO: 724467 - DNA, 25 bp, Artificial sequence
  Synthetic oligonucleotide
tgatgcgtatcgaactcagtccggt

SEQ ID NO: 724468 - DNA, 25 bp, Artificial sequence
  Synthetic oligonucleotide
tggtactgatgcgtatcgaactcag

SEQ ID NO: 724469 - DNA, 25 bp, Artificial sequence
  Synthetic oligonucleotide
gggaggtggtactgatgcgtatcga

SEQ ID NO: 724470 - DNA, 25 bp, Artificial sequence
  Synthetic oligonucleotide
ggctgtggggaggtggtactgatgc

SEQ ID NO: 724471 - DNA, 25 bp, Artificial sequence
  Synthetic oligonucleotide
ggtgatggctgtggggaggtggtac

SEQ ID NO: 724472 - DNA, 25 bp, Artificial sequence
  Synthetic oligonucleotide
catggtttccggagattcgatagcc

SEQ ID NO: 724473 - DNA, 25 bp, Artificial sequence
  Synthetic oligonucleotide
gcgaagctgccaaattccctgtccc

SEQ ID NO: 724474 - DNA, 25 bp, Artificial sequence
  Synthetic oligonucleotide
aatgatgaaaacaccggatcaggtt

SEQ ID NO: 724475 - DNA, 25 bp, Artificial sequence
  Synthetic oligonucleotide
ttggaaaatgatgaaaacaccggat

SEQ ID NO: 724476 - DNA, 25 bp, Artificial sequence
  Synthetic oligonucleotide
gatcgattggaaaatgatgaaaaca

SEQ ID NO: 724477 - DNA, 25 bp, Artificial sequence
  Synthetic oligonucleotide
ccaagtgatcgattggaaaatgatg

SEQ ID NO: 724478 - DNA, 25 bp, Artificial sequence
  Synthetic oligonucleotide
agttgcccaagtgatcgattggaaa

SEQ ID NO: 724479 - DNA, 25 bp, Artificial sequence
  Synthetic oligonucleotide
ccgtggagttgcccaagtgatcgat

SEQ ID NO: 724480 - DNA, 25 bp, Artificial sequence
  Synthetic oligonucleotide
acggaaccgtggagttgcccaagtg

SEQ ID NO: 724481 - DNA, 25 bp, Artificial sequence
  Synthetic oligonucleotide
ttgaagacggaaccgtggagttgcc

SEQ ID NO: 724482 - DNA, 25 bp, Artificial sequence
  Synthetic oligonucleotide
atatcgttgaagacggaaccgtgga

SEQ ID NO: 724483 - DNA, 25 bp, Artificial sequence
  Synthetic oligonucleotide
ccatccatatcgttgaagacggaac

SEQ ID NO: 724484 - DNA, 25 bp, Artificial sequence
  Synthetic oligonucleotide
ctgtccccatccatatcgttgaaga

SEQ ID NO: 724485 - DNA, 25 bp, Artificial sequence
  Synthetic oligonucleotide
tatctgcccgcctctgccatccatg

SEQ ID NO: 724486 - DNA, 25 bp, Artificial sequence
  Synthetic oligonucleotide
ctgccaaattccctgtccccatcca

SEQ ID NO: 724487 - DNA, 25 bp, Artificial sequence
  Synthetic oligonucleotide
ggctaacgacaccattacggtgatg

SEQ ID NO: 724488 - DNA, 25 bp, Artificial sequence
  Synthetic oligonucleotide
ctacagcgaagctgccaaattccct

SEQ ID NO: 724489 - DNA, 25 bp, Artificial sequence
  Synthetic oligonucleotide
ggggagctacagcgaagctgccaaa

SEQ ID NO: 724490 - DNA, 25 bp, Artificial sequence
  Synthetic oligonucleotide
ccatccgggggagctacagcgaagc

SEQ ID NO: 724491 - DNA, 25 bp, Artificial sequence
  Synthetic oligonucleotide
tgtttcccatccgggggagctacag

SEQ ID NO: 724492 - DNA, 25 bp, Artificial sequence
  Synthetic oligonucleotide
cattggtgtttcccatccgggggag

SEQ ID NO: 724493 - DNA, 25 bp, Artificial sequence
  Synthetic oligonucleotide
gcctgacattggtgtttcccatccg

SEQ ID NO: 724494 - DNA, 25 bp, Artificial sequence
  Synthetic oligonucleotide
agatatgcctgacattggtgtttcc

SEQ ID NO: 724495 - DNA, 25 bp, Artificial sequence
  Synthetic oligonucleotide
gcggagagatatgcctgacattggt

SEQ ID NO: 724496 - DNA, 25 bp, Artificial sequence
  Synthetic oligonucleotide
gggcaggcggagagatatgcctgac

SEQ ID NO: 724497 - DNA, 25 bp, Artificial sequence
  Synthetic oligonucleotide
ttaccagggcaggcggagagatatg

SEQ ID NO: 724498 - DNA, 25 bp, Artificial sequence
  Synthetic oligonucleotide
ggcgggttaccagggcaggcggaga

SEQ ID NO: 724499 - DNA, 25 bp, Artificial sequence
  Synthetic oligonucleotide
catccatgaggggcctttttccggg

SEQ ID NO: 724500 - DNA, 25 bp, Artificial sequence
  Synthetic oligonucleotide
aattccctgtccccatccatatcgt

SEQ ID NO: 724501 - DNA, 25 bp, Artificial sequence
  Synthetic oligonucleotide
taagcccaccggggccgtgatggag

SEQ ID NO: 724502 - DNA, 25 bp, Artificial sequence
  Synthetic oligonucleotide
cagcggcaagatccgaaccgggcct

SEQ ID NO: 724503 - DNA, 25 bp, Artificial sequence
  Synthetic oligonucleotide
agatggcagcggcaagatccgaacc

SEQ ID NO: 724504 - DNA, 25 bp, Artificial sequence
  Synthetic oligonucleotide
gtacccagatggcagcggcaagatc

SEQ ID NO: 724505 - DNA, 25 bp, Artificial sequence
  Synthetic oligonucleotide
gcggatggtacccagatggcagcgg

SEQ ID NO: 724506 - DNA, 25 bp, Artificial sequence
  Synthetic oligonucleotide
cgctttgcggatggtacccagatgg

SEQ ID NO: 724507 - DNA, 25 bp, Artificial sequence
  Synthetic oligonucleotide
tacgttcgctttgcggatggtaccc

SEQ ID NO: 724508 - DNA, 25 bp, Artificial sequence
  Synthetic oligonucleotide
gctggtacgttcgctttgcggatgg

SEQ ID NO: 724509 - DNA, 25 bp, Artificial sequence
  Synthetic oligonucleotide
ccaacggctggtacgttcgctttgc

SEQ ID NO: 724510 - DNA, 25 bp, Artificial sequence
  Synthetic oligonucleotide
caacttccaacggctggtacgttcg

SEQ ID NO: 724511 - DNA, 25 bp, Artificial sequence
  Synthetic oligonucleotide
gagcgggacaacttccaacggctgg

SEQ ID NO: 724512 - DNA, 25 bp, Artificial sequence
  Synthetic oligonucleotide
gatggagagcgggacaacttccaac

SEQ ID NO: 724513 - DNA, 25 bp, Artificial sequence
  Synthetic oligonucleotide
cattacggtgatggctgtggggagg

SEQ ID NO: 724514 - DNA, 25 bp, Artificial sequence
  Synthetic oligonucleotide
ccaccggggccgtgatggagagcgg

SEQ ID NO: 724515 - DNA, 25 bp, Artificial sequence
  Synthetic oligonucleotide
ggagctaacgtgatacagctaccag

SEQ ID NO: 724516 - DNA, 25 bp, Artificial sequence
  Synthetic oligonucleotide
cctggatcgccaaggtggaagagat

SEQ ID NO: 724517 - DNA, 25 bp, Artificial sequence
  Synthetic oligonucleotide
acttgtcacaggtaagcccaccggg

SEQ ID NO: 724518 - DNA, 25 bp, Artificial sequence
  Synthetic oligonucleotide
ctgtggttccgaactaaccctatca

SEQ ID NO: 724519 - DNA, 25 bp, Artificial sequence
  Synthetic oligonucleotide
gtaacgaggcgacttgtcacaggta

SEQ ID NO: 724520 - DNA, 25 bp, Artificial sequence
  Synthetic oligonucleotide
gggagcgtaacgaggcgacttgtca

SEQ ID NO: 724521 - DNA, 25 bp, Artificial sequence
  Synthetic oligonucleotide
tatcgtggggagcgtaacgaggcga

SEQ ID NO: 724522 - DNA, 25 bp, Artificial sequence
  Synthetic oligonucleotide
agacaatatcgtggggagcgtaacg

SEQ ID NO: 724523 - DNA, 25 bp, Artificial sequence
  Synthetic oligonucleotide
tacgacagacaatatcgtggggagc

SEQ ID NO: 724524 - DNA, 25 bp, Artificial sequence
  Synthetic oligonucleotide
gttttatacgacagacaatatcgtg

SEQ ID NO: 724525 - DNA, 25 bp, Artificial sequence
  Synthetic oligonucleotide
ggtcaggttttatacgacagacaat

SEQ ID NO: 724526 - DNA, 25 bp, Artificial sequence
  Synthetic oligonucleotide
ggagtgggtcaggttttatacgaca

SEQ ID NO: 724527 - DNA, 25 bp, Artificial sequence
  Synthetic oligonucleotide
ctggaaggagtgggtcaggttttat

SEQ ID NO: 724528 - DNA, 25 bp, Artificial sequence
  Synthetic oligonucleotide
gggccgtgatggagagcgggacaac

SEQ ID NO: 724529 - DNA, 25 bp, Artificial sequence
  Synthetic oligonucleotide
ggatggcctgccactgctgggcagg

SEQ ID NO: 724530 - DNA, 25 bp, Artificial sequence
  Synthetic oligonucleotide
aatggaacctggaaggagtgggtca

SEQ ID NO: 724531 - DNA, 25 bp, Artificial sequence
  Synthetic oligonucleotide
actgggggctaacgacaccattacg

SEQ ID NO: 724532 - DNA, 25 bp, Artificial sequence
  Synthetic oligonucleotide
gcaggcactgggggctaacgacacc

SEQ ID NO: 724533 - DNA, 25 bp, Artificial sequence
  Synthetic oligonucleotide
gacggcgcaggcactgggggctaac

SEQ ID NO: 724534 - DNA, 25 bp, Artificial sequence
  Synthetic oligonucleotide
ttcgcgacggcgcaggcactggggg

SEQ ID NO: 724535 - DNA, 25 bp, Artificial sequence
  Synthetic oligonucleotide
tgtttctttcgcgacggcgcaggca

SEQ ID NO: 724536 - DNA, 25 bp, Artificial sequence
  Synthetic oligonucleotide
gcagctctgtttctttcgcgacggc

SEQ ID NO: 724537 - DNA, 25 bp, Artificial sequence
  Synthetic oligonucleotide
acggtagcagctctgtttctttcgc

SEQ ID NO: 724538 - DNA, 25 bp, Artificial sequence
  Synthetic oligonucleotide
atctcaacggtagcagctctgtttc

SEQ ID NO: 724539 - DNA, 25 bp, Artificial sequence
  Synthetic oligonucleotide
gggcctatctcaacggtagcagctc

SEQ ID NO: 724540 - DNA, 25 bp, Artificial sequence
  Synthetic oligonucleotide
gttcgtggggcctatctcaacggta

SEQ ID NO: 724541 - DNA, 25 bp, Artificial sequence
  Synthetic oligonucleotide
gcagggggttcgtggggcctatctc

SEQ ID NO: 724542 - DNA, 25 bp, Artificial sequence
  Synthetic oligonucleotide
ggcctttcgtttggagctaacgtga

SEQ ID NO: 724543 - DNA, 25 bp, Artificial sequence
  Synthetic oligonucleotide
cctgccactgctgggcagggggttc

SEQ ID NO: 724544 - DNA, 25 bp, Artificial sequence
  Synthetic oligonucleotide
tcgtttggagctaacgtgatacagc

SEQ ID NO: 724545 - DNA, 25 bp, Artificial sequence
  Synthetic oligonucleotide
tccagcggatggcctgccactgctg

SEQ ID NO: 724546 - DNA, 25 bp, Artificial sequence
  Synthetic oligonucleotide
atcccctccagcggatggcctgcca

SEQ ID NO: 724547 - DNA, 25 bp, Artificial sequence
  Synthetic oligonucleotide
caattggatcccctccagcggatgg

SEQ ID NO: 724548 - DNA, 25 bp, Artificial sequence
  Synthetic oligonucleotide
tgacctgcaattggatcccctccag

SEQ ID NO: 724549 - DNA, 25 bp, Artificial sequence
  Synthetic oligonucleotide
ccggggtgacctgcaattggatccc

SEQ ID NO: 724550 - DNA, 25 bp, Artificial sequence
  Synthetic oligonucleotide
tcaataccggggtgacctgcaattg

SEQ ID NO: 724551 - DNA, 25 bp, Artificial sequence
  Synthetic oligonucleotide
cgggcttcaataccggggtgacctg

SEQ ID NO: 724552 - DNA, 25 bp, Artificial sequence
  Synthetic oligonucleotide
gctgccttcgttacgggcttcaata

SEQ ID NO: 724553 - DNA, 25 bp, Artificial sequence
  Synthetic oligonucleotide
ctaccagctgccttcgttacgggct

SEQ ID NO: 724554 - DNA, 25 bp, Artificial sequence
  Synthetic oligonucleotide
atacagctaccagctgccttcgtta

SEQ ID NO: 724555 - DNA, 25 bp, Artificial sequence
  Synthetic oligonucleotide
aacgtgatacagctaccagctgcct

SEQ ID NO: 724556 - DNA, 25 bp, Artificial sequence
  Synthetic oligonucleotide
gacaccattacggtgatggctgtgg

SEQ ID NO: 724557 - DNA, 25 bp, Artificial sequence
  Synthetic oligonucleotide
cactgctgggcagggggttcgtggg

SEQ ID NO: 724558 - DNA, 25 bp, Artificial sequence
  Synthetic oligonucleotide
actggcgagcttcgatgcatcgaac

SEQ ID NO: 724559 - DNA, 25 bp, Artificial sequence
  Synthetic oligonucleotide
ctggggttcgacgatgtcggtcacc

SEQ ID NO: 724560 - DNA, 25 bp, Artificial sequence
  Synthetic oligonucleotide
aacgagtatgtacgctacgccgacg

SEQ ID NO: 724561 - DNA, 25 bp, Artificial sequence
  Synthetic oligonucleotide
gtttcaacgagtatgtacgctacgc

SEQ ID NO: 724562 - DNA, 25 bp, Artificial sequence
  Synthetic oligonucleotide
ctgtcggtttcaacgagtatgtacg

SEQ ID NO: 724563 - DNA, 25 bp, Artificial sequence
  Synthetic oligonucleotide
gcgggactgtcggtttcaacgagta

SEQ ID NO: 724564 - DNA, 25 bp, Artificial sequence
  Synthetic oligonucleotide
cagcgcggcgggactgtcggtttca

SEQ ID NO: 724565 - DNA, 25 bp, Artificial sequence
  Synthetic oligonucleotide
atcatccagcgcggcgggactgtcg

SEQ ID NO: 724566 - DNA, 25 bp, Artificial sequence
  Synthetic oligonucleotide
gcgccatcatccagcgcggcgggac

SEQ ID NO: 724567 - DNA, 25 bp, Artificial sequence
  Synthetic oligonucleotide
catccggcgccatcatccagcgcgg

SEQ ID NO: 724568 - DNA, 25 bp, Artificial sequence
  Synthetic oligonucleotide
acaatccatccggcgccatcatcca

SEQ ID NO: 724569 - DNA, 25 bp, Artificial sequence
  Synthetic oligonucleotide
atcgaacaatccatccggcgccatc

SEQ ID NO: 724570 - DNA, 25 bp, Artificial sequence
  Synthetic oligonucleotide
tacgctacgccgacggaacccagat

SEQ ID NO: 724571 - DNA, 25 bp, Artificial sequence
  Synthetic oligonucleotide
gagcttcgatgcatcgaacaatcca

SEQ ID NO: 724572 - DNA, 25 bp, Artificial sequence
  Synthetic oligonucleotide
acgccgacggaacccagatctgctg

SEQ ID NO: 724573 - DNA, 25 bp, Artificial sequence
  Synthetic oligonucleotide
tgtcggactggcgagcttcgatgca

SEQ ID NO: 724574 - DNA, 25 bp, Artificial sequence
  Synthetic oligonucleotide
tcaaccttgtcggactggcgagctt

SEQ ID NO: 724575 - DNA, 25 bp, Artificial sequence
  Synthetic oligonucleotide
agccagttcaaccttgtcggactgg

SEQ ID NO: 724576 - DNA, 25 bp, Artificial sequence
  Synthetic oligonucleotide
cagtacagccagttcaaccttgtcg

SEQ ID NO: 724577 - DNA, 25 bp, Artificial sequence
  Synthetic oligonucleotide
gtgttgcagtacagccagttcaacc

SEQ ID NO: 724578 - DNA, 25 bp, Artificial sequence
  Synthetic oligonucleotide
cgctgggtgttgcagtacagccagt

SEQ ID NO: 724579 - DNA, 25 bp, Artificial sequence
  Synthetic oligonucleotide
tggtcgcgctgggtgttgcagtaca

SEQ ID NO: 724580 - DNA, 25 bp, Artificial sequence
  Synthetic oligonucleotide
gggtaactggtcgcgctgggtgttg

SEQ ID NO: 724581 - DNA, 25 bp, Artificial sequence
  Synthetic oligonucleotide
aggccgggggtaactggtcgcgctg

SEQ ID NO: 724582 - DNA, 25 bp, Artificial sequence
  Synthetic oligonucleotide
catgcggatcaaggccgggggtaac

SEQ ID NO: 724583 - DNA, 25 bp, Artificial sequence
  Synthetic oligonucleotide
ccagtacatgcggatcaaggccggg

SEQ ID NO: 724584 - DNA, 25 bp, Artificial sequence
  Synthetic oligonucleotide
actggccagtacatgcggatcaagg

SEQ ID NO: 724585 - DNA, 25 bp, Artificial sequence
  Synthetic oligonucleotide
cgatgcatcgaacaatccatccggc

SEQ ID NO: 724586 - DNA, 25 bp, Artificial sequence
  Synthetic oligonucleotide
acgttgtcgttctatatcactccgg

SEQ ID NO: 724587 - DNA, 25 bp, Artificial sequence
  Synthetic oligonucleotide
aggtggaagagatcaagtcacgata

SEQ ID NO: 724588 - DNA, 25 bp, Artificial sequence
  Synthetic oligonucleotide
cagcaggaaacaacgcttcccgtcc

SEQ ID NO: 724589 - DNA, 25 bp, Artificial sequence
  Synthetic oligonucleotide
gagagcagcaggaaacaacgcttcc

SEQ ID NO: 724590 - DNA, 25 bp, Artificial sequence
  Synthetic oligonucleotide
cccgatgagagcagcaggaaacaac

SEQ ID NO: 724591 - DNA, 25 bp, Artificial sequence
  Synthetic oligonucleotide
ggtcaacccgatgagagcagcagga

SEQ ID NO: 724592 - DNA, 25 bp, Artificial sequence
  Synthetic oligonucleotide
tgtcatggtcaacccgatgagagca

SEQ ID NO: 724593 - DNA, 25 bp, Artificial sequence
  Synthetic oligonucleotide
ccgtctgtcatggtcaacccgatga

SEQ ID NO: 724594 - DNA, 25 bp, Artificial sequence
  Synthetic oligonucleotide
cggcctccgtctgtcatggtcaacc

SEQ ID NO: 724595 - DNA, 25 bp, Artificial sequence
  Synthetic oligonucleotide
ttctcccggcctccgtctgtcatgg

SEQ ID NO: 724596 - DNA, 25 bp, Artificial sequence
  Synthetic oligonucleotide
gtctcgttctcccggcctccgtctg

SEQ ID NO: 724597 - DNA, 25 bp, Artificial sequence
  Synthetic oligonucleotide
cactccggttgcttactcgtggggg

SEQ ID NO: 724598 - DNA, 25 bp, Artificial sequence
  Synthetic oligonucleotide
gtatgtacgctacgccgacggaacc

SEQ ID NO: 724599 - DNA, 25 bp, Artificial sequence
  Synthetic oligonucleotide
tcgttctatatcactccggttgctt

SEQ ID NO: 724600 - DNA, 25 bp, Artificial sequence
  Synthetic oligonucleotide
taccagttgaattccgccactggcc

SEQ ID NO: 724601 - DNA, 25 bp, Artificial sequence
  Synthetic oligonucleotide
gctggtacgttgtcgttctatatca

SEQ ID NO: 724602 - DNA, 25 bp, Artificial sequence
  Synthetic oligonucleotide
cagccggctggtacgttgtcgttct

SEQ ID NO: 724603 - DNA, 25 bp, Artificial sequence
  Synthetic oligonucleotide
gcctaccagccggctggtacgttgt

SEQ ID NO: 724604 - DNA, 25 bp, Artificial sequence
  Synthetic oligonucleotide
accatggcctaccagccggctggta

SEQ ID NO: 724605 - DNA, 25 bp, Artificial sequence
  Synthetic oligonucleotide
gggagccaccatggcctaccagccg

SEQ ID NO: 724606 - DNA, 25 bp, Artificial sequence
  Synthetic oligonucleotide
caatgtgggagccaccatggcctac

SEQ ID NO: 724607 - DNA, 25 bp, Artificial sequence
  Synthetic oligonucleotide
cactaccaatgtgggagccaccatg

SEQ ID NO: 724608 - DNA, 25 bp, Artificial sequence
  Synthetic oligonucleotide
aacaccactaccaatgtgggagcca

SEQ ID NO: 724609 - DNA, 25 bp, Artificial sequence
  Synthetic oligonucleotide
tggggcaacaccactaccaatgtgg

SEQ ID NO: 724610 - DNA, 25 bp, Artificial sequence
  Synthetic oligonucleotide
atctgctggggcaacaccactacca

SEQ ID NO: 724611 - DNA, 25 bp, Artificial sequence
  Synthetic oligonucleotide
acccagatctgctggggcaacacca

SEQ ID NO: 724612 - DNA, 25 bp, Artificial sequence
  Synthetic oligonucleotide
acggaacccagatctgctggggcaa

SEQ ID NO: 724613 - DNA, 25 bp, Artificial sequence
  Synthetic oligonucleotide
tatatcactccggttgcttactcgt

SEQ ID NO: 724614 - DNA, 25 bp, Artificial sequence
  Synthetic oligonucleotide
cgcaggccgacatgggaatctcggc

SEQ ID NO: 724615 - DNA, 25 bp, Artificial sequence
  Synthetic oligonucleotide
tcgcgcccaatcagatgggctgggc

SEQ ID NO: 724616 - DNA, 25 bp, Artificial sequence
  Synthetic oligonucleotide
ggggcgtcgcgcccaatcagatggg

SEQ ID NO: 724617 - DNA, 25 bp, Artificial sequence
  Synthetic oligonucleotide
tacctggggggcgtcgcgcccaatc

SEQ ID NO: 724618 - DNA, 25 bp, Artificial sequence
  Synthetic oligonucleotide
cttgagttacctggggggcgtcgcg

SEQ ID NO: 724619 - DNA, 25 bp, Artificial sequence
  Synthetic oligonucleotide
ccggccaacgccttgagttacctgg

SEQ ID NO: 724620 - DNA, 25 bp, Artificial sequence
  Synthetic oligonucleotide
tcgacgccggccaacgccttgagtt

SEQ ID NO: 724621 - DNA, 25 bp, Artificial sequence
  Synthetic oligonucleotide
aatgcttcgacgccggccaacgcct

SEQ ID NO: 724622 - DNA, 25 bp, Artificial sequence
  Synthetic oligonucleotide
ctgaacaatgcttcgacgccggcca

SEQ ID NO: 724623 - DNA, 25 bp, Artificial sequence
  Synthetic oligonucleotide
tcgggccctgaacaatgcttcgacg

SEQ ID NO: 724624 - DNA, 25 bp, Artificial sequence
  Synthetic oligonucleotide
tgttggtcgggccctgaacaatgct

SEQ ID NO: 724625 - DNA, 25 bp, Artificial sequence
  Synthetic oligonucleotide
tctcggctgttggtcgggccctgaa

SEQ ID NO: 724626 - DNA, 25 bp, Artificial sequence
  Synthetic oligonucleotide
tccgccactggccagtacatgcgga

SEQ ID NO: 724627 - DNA, 25 bp, Artificial sequence
  Synthetic oligonucleotide
ccgacatgggaatctcggctgttgg

SEQ ID NO: 724628 - DNA, 25 bp, Artificial sequence
  Synthetic oligonucleotide
gctgggctggcaacgcgatgaatac

SEQ ID NO: 724629 - DNA, 25 bp, Artificial sequence
  Synthetic oligonucleotide
agcaggcgcaggccgacatgggaat

SEQ ID NO: 724630 - DNA, 25 bp, Artificial sequence
  Synthetic oligonucleotide
acgggccagcaggcgcaggccgaca

SEQ ID NO: 724631 - DNA, 25 bp, Artificial sequence
  Synthetic oligonucleotide
tcctcgacgggccagcaggcgcagg

SEQ ID NO: 724632 - DNA, 25 bp, Artificial sequence
  Synthetic oligonucleotide
gcggtgtcctcgacgggccagcagg

SEQ ID NO: 724633 - DNA, 25 bp, Artificial sequence
  Synthetic oligonucleotide
cctgggcggtgtcctcgacgggcca

SEQ ID NO: 724634 - DNA, 25 bp, Artificial sequence
  Synthetic oligonucleotide
ggatcaaaccctgggcggtgtcctc

SEQ ID NO: 724635 - DNA, 25 bp, Artificial sequence
  Synthetic oligonucleotide
ggcagggatcaaaccctgggcggtg

SEQ ID NO: 724636 - DNA, 25 bp, Artificial sequence
  Synthetic oligonucleotide
caccctggcagggatcaaaccctgg

SEQ ID NO: 724637 - DNA, 25 bp, Artificial sequence
  Synthetic oligonucleotide
gggggccaccctggcagggatcaaa

SEQ ID NO: 724638 - DNA, 25 bp, Artificial sequence
  Synthetic oligonucleotide
ccagtggggggccaccctggcaggg

SEQ ID NO: 724639 - DNA, 25 bp, Artificial sequence
  Synthetic oligonucleotide
caacaaccagtggggggccaccctg

SEQ ID NO: 724640 - DNA, 25 bp, Artificial sequence
  Synthetic oligonucleotide
gacatcaacaaccagtggggggcca

SEQ ID NO: 724641 - DNA, 25 bp, Artificial sequence
  Synthetic oligonucleotide
tgggaatctcggctgttggtcgggc

SEQ ID NO: 724642 - DNA, 25 bp, Artificial sequence
  Synthetic oligonucleotide
cggcggtgccttcgccggtgaacaa

SEQ ID NO: 724643 - DNA, 25 bp, Artificial sequence
  Synthetic oligonucleotide
ttcgacgatgtcggtcaccgaaacg

SEQ ID NO: 724644 - DNA, 25 bp, Artificial sequence
  Synthetic oligonucleotide
cagtggtaccagttgaattccgcca

SEQ ID NO: 724645 - DNA, 25 bp, Artificial sequence
  Synthetic oligonucleotide
gtccagcagtggtaccagttgaatt

SEQ ID NO: 724646 - DNA, 25 bp, Artificial sequence
  Synthetic oligonucleotide
ttcgccgtccagcagtggtaccagt

SEQ ID NO: 724647 - DNA, 25 bp, Artificial sequence
  Synthetic oligonucleotide
ccagacttcgccgtccagcagtggt

SEQ ID NO: 724648 - DNA, 25 bp, Artificial sequence
  Synthetic oligonucleotide
cggcaacccagacttcgccgtccag

SEQ ID NO: 724649 - DNA, 25 bp, Artificial sequence
  Synthetic oligonucleotide
gcagcacggcaacccagacttcgcc

SEQ ID NO: 724650 - DNA, 25 bp, Artificial sequence
  Synthetic oligonucleotide
tgcatatgcagcacggcaacccaga

SEQ ID NO: 724651 - DNA, 25 bp, Artificial sequence
  Synthetic oligonucleotide
atgtcttgcatatgcagcacggcaa

SEQ ID NO: 724652 - DNA, 25 bp, Artificial sequence
  Synthetic oligonucleotide
agggctatgtcttgcatatgcagca

SEQ ID NO: 724653 - DNA, 25 bp, Artificial sequence
  Synthetic oligonucleotide
atgcccagggctatgtcttgcatat

SEQ ID NO: 724654 - DNA, 25 bp, Artificial sequence
  Synthetic oligonucleotide
tgaacaatgcccagggctatgtctt

SEQ ID NO: 724655 - DNA, 25 bp, Artificial sequence
  Synthetic oligonucleotide
ccaatcagatgggctgggctggcaa

SEQ ID NO: 724656 - DNA, 25 bp, Artificial sequence
  Synthetic oligonucleotide
tgccttcgccggtgaacaatgccca

SEQ ID NO: 724657 - DNA, 25 bp, Artificial sequence
  Synthetic oligonucleotide
agatgggctgggctggcaacgcgat

SEQ ID NO: 724658 - DNA, 25 bp, Artificial sequence
  Synthetic oligonucleotide
atggcacggcggtgccttcgccggt

SEQ ID NO: 724659 - DNA, 25 bp, Artificial sequence
  Synthetic oligonucleotide
acgctcatggcacggcggtgccttc

SEQ ID NO: 724660 - DNA, 25 bp, Artificial sequence
  Synthetic oligonucleotide
ggctatacgctcatggcacggcggt

SEQ ID NO: 724661 - DNA, 25 bp, Artificial sequence
  Synthetic oligonucleotide
tctcggggctatacgctcatggcac

SEQ ID NO: 724662 - DNA, 25 bp, Artificial sequence
  Synthetic oligonucleotide
tgaccgtctcggggctatacgctca

SEQ ID NO: 724663 - DNA, 25 bp, Artificial sequence
  Synthetic oligonucleotide
attcgctgaccgtctcggggctata

SEQ ID NO: 724664 - DNA, 25 bp, Artificial sequence
  Synthetic oligonucleotide
acctcgattcgctgaccgtctcggg

SEQ ID NO: 724665 - DNA, 25 bp, Artificial sequence
  Synthetic oligonucleotide
cggcggacctcgattcgctgaccgt

SEQ ID NO: 724666 - DNA, 25 bp, Artificial sequence
  Synthetic oligonucleotide
tgaatacggcggacctcgattcgct

SEQ ID NO: 724667 - DNA, 25 bp, Artificial sequence
  Synthetic oligonucleotide
acgcgatgaatacggcggacctcga

SEQ ID NO: 724668 - DNA, 25 bp, Artificial sequence
  Synthetic oligonucleotide
ctggcaacgcgatgaatacggcgga

SEQ ID NO: 724669 - DNA, 25 bp, Artificial sequence
  Synthetic oligonucleotide
ttgaattccgccactggccagtaca

SEQ ID NO: 724670 - DNA, 25 bp, Artificial sequence
  Synthetic oligonucleotide
cgccggtgaacaatgcccagggcta

SEQ ID NO: 724671 - DNA, 25 bp, Artificial sequence
  Synthetic oligonucleotide
tcagctatgaacatccaatgggata

SEQ ID NO: 724672 - DNA, 25 bp, Artificial sequence
  Synthetic oligonucleotide
ccgtccctggggttcgacgatgtcg

SEQ ID NO: 724673 - DNA, 25 bp, Artificial sequence
  Synthetic oligonucleotide
tggccagcgtgcaggccaagcgcct

SEQ ID NO: 724674 - DNA, 25 bp, Artificial sequence
  Synthetic oligonucleotide
aggccttggccagcgtgcaggccaa

SEQ ID NO: 724675 - DNA, 25 bp, Artificial sequence
  Synthetic oligonucleotide
gcgatcaggccttggccagcgtgca

SEQ ID NO: 724676 - DNA, 25 bp, Artificial sequence
  Synthetic oligonucleotide
atgtgcgcgatcaggccttggccag

SEQ ID NO: 724677 - DNA, 25 bp, Artificial sequence
  Synthetic oligonucleotide
cggcagatgtgcgcgatcaggcctt

SEQ ID NO: 724678 - DNA, 25 bp, Artificial sequence
  Synthetic oligonucleotide
aaggccgcggcagatgtgcgcgatc

SEQ ID NO: 724679 - DNA, 25 bp, Artificial sequence
  Synthetic oligonucleotide
cctgcaaaggccgcggcagatgtgc

SEQ ID NO: 724680 - DNA, 25 bp, Artificial sequence
  Synthetic oligonucleotide
gtcagccctgcaaaggccgcggcag

SEQ ID NO: 724681 - DNA, 25 bp, Artificial sequence
  Synthetic oligonucleotide
aagtacgtcagccctgcaaaggccg

SEQ ID NO: 724682 - DNA, 25 bp, Artificial sequence
  Synthetic oligonucleotide
tgggataagtacgtcagccctgcaa

SEQ ID NO: 724683 - DNA, 25 bp, Artificial sequence
  Synthetic oligonucleotide
aggccaagcgccttctggcctatcg

SEQ ID NO: 724684 - DNA, 25 bp, Artificial sequence
  Synthetic oligonucleotide
atgaacatccaatgggataagtacg

SEQ ID NO: 724685 - DNA, 25 bp, Artificial sequence
  Synthetic oligonucleotide
gcgccttctggcctatcgggaagaa

SEQ ID NO: 724686 - DNA, 25 bp, Artificial sequence
  Synthetic oligonucleotide
tagcgttcagctatgaacatccaat

SEQ ID NO: 724687 - DNA, 25 bp, Artificial sequence
  Synthetic oligonucleotide
tcgaggtagcgttcagctatgaaca

SEQ ID NO: 724688 - DNA, 25 bp, Artificial sequence
  Synthetic oligonucleotide
gaaaagtcgaggtagcgttcagcta

SEQ ID NO: 724689 - DNA, 25 bp, Artificial sequence
  Synthetic oligonucleotide
aggatggaaaagtcgaggtagcgtt

SEQ ID NO: 724690 - DNA, 25 bp, Artificial sequence
  Synthetic oligonucleotide
tcgaccaggatggaaaagtcgaggt

SEQ ID NO: 724691 - DNA, 25 bp, Artificial sequence
  Synthetic oligonucleotide
attccggtcgaccaggatggaaaag

SEQ ID NO: 724692 - DNA, 25 bp, Artificial sequence
  Synthetic oligonucleotide
agtcaattccggtcgaccaggatgg

SEQ ID NO: 724693 - DNA, 25 bp, Artificial sequence
  Synthetic oligonucleotide
agatcgagtcaattccggtcgacca

SEQ ID NO: 724694 - DNA, 25 bp, Artificial sequence
  Synthetic oligonucleotide
ccagggagatcgagtcaattccggt

SEQ ID NO: 724695 - DNA, 25 bp, Artificial sequence
  Synthetic oligonucleotide
agtttcccagggagatcgagtcaat

SEQ ID NO: 724696 - DNA, 25 bp, Artificial sequence
  Synthetic oligonucleotide
tgatgcagtttcccagggagatcga

SEQ ID NO: 724697 - DNA, 25 bp, Artificial sequence
  Synthetic oligonucleotide
aagtgatgatgcagtttcccaggga

SEQ ID NO: 724698 - DNA, 25 bp, Artificial sequence
  Synthetic oligonucleotide
atccaatgggataagtacgtcagcc

SEQ ID NO: 724699 - DNA, 25 bp, Artificial sequence
  Synthetic oligonucleotide
cggactatggcgcctggatcgccaa

SEQ ID NO: 724700 - DNA, 25 bp, Artificial sequence
  Synthetic oligonucleotide
cgcctgggcgtcagccctgtggttc

SEQ ID NO: 724701 - DNA, 25 bp, Artificial sequence
  Synthetic oligonucleotide
caggctcgcctgggcgtcagccctg

SEQ ID NO: 724702 - DNA, 25 bp, Artificial sequence
  Synthetic oligonucleotide
gaactccaggctcgcctgggcgtca

SEQ ID NO: 724703 - DNA, 25 bp, Artificial sequence
  Synthetic oligonucleotide
aatagccgaactccaggctcgcctg

SEQ ID NO: 724704 - DNA, 25 bp, Artificial sequence
  Synthetic oligonucleotide
tgcctgaatagccgaactccaggct

SEQ ID NO: 724705 - DNA, 25 bp, Artificial sequence
  Synthetic oligonucleotide
acccgatgcctgaatagccgaactc

SEQ ID NO: 724706 - DNA, 25 bp, Artificial sequence
  Synthetic oligonucleotide
cacgatacccgatgcctgaatagcc

SEQ ID NO: 724707 - DNA, 25 bp, Artificial sequence
  Synthetic oligonucleotide
tcaagtcacgatacccgatgcctga

SEQ ID NO: 724708 - DNA, 25 bp, Artificial sequence
  Synthetic oligonucleotide
aagagatcaagtcacgatacccgat

SEQ ID NO: 724709 - DNA, 25 bp, Artificial sequence
  Synthetic oligonucleotide
gaaaacaccggatcaggtttccaga

SEQ ID NO: 724710 - DNA, 25 bp, Artificial sequence
  Synthetic oligonucleotide
tcgccaaggtggaagagatcaagtc

SEQ ID NO: 724711 - DNA, 25 bp, Artificial sequence
  Synthetic oligonucleotide
gcgtgcaggccaagcgccttctggc

SEQ ID NO: 724712 - DNA, 25 bp, Artificial sequence
  Synthetic oligonucleotide
atggcgcctggatcgccaaggtgga

SEQ ID NO: 724713 - DNA, 25 bp, Artificial sequence
  Synthetic oligonucleotide
tccaccaggtgacctctgaagtgat

SEQ ID NO: 724714 - DNA, 25 bp, Artificial sequence
  Synthetic oligonucleotide
tcgagccggactatggcgcctggat

SEQ ID NO: 724715 - DNA, 25 bp, Artificial sequence
  Synthetic oligonucleotide
ccggcgtcgagccggactatggcgc

SEQ ID NO: 724716 - DNA, 25 bp, Artificial sequence
  Synthetic oligonucleotide
tcaaggccggcgtcgagccggacta

SEQ ID NO: 724717 - DNA, 25 bp, Artificial sequence
  Synthetic oligonucleotide
atgcgatcaaggccggcgtcgagcc

SEQ ID NO: 724718 - DNA, 25 bp, Artificial sequence
  Synthetic oligonucleotide
agttcgatgcgatcaaggccggcgt

SEQ ID NO: 724719 - DNA, 25 bp, Artificial sequence
  Synthetic oligonucleotide
aagccgagttcgatgcgatcaaggc

SEQ ID NO: 724720 - DNA, 25 bp, Artificial sequence
  Synthetic oligonucleotide
agaccgaagccgagttcgatgcgat

SEQ ID NO: 724721 - DNA, 25 bp, Artificial sequence
  Synthetic oligonucleotide
cgctcaagaccgaagccgagttcga

SEQ ID NO: 724722 - DNA, 25 bp, Artificial sequence
  Synthetic oligonucleotide
agcaatccgctcaagaccgaagccg

SEQ ID NO: 724723 - DNA, 25 bp, Artificial sequence
  Synthetic oligonucleotide
gaagaaagcaatccgctcaagaccg

SEQ ID NO: 724724 - DNA, 25 bp, Artificial sequence
  Synthetic oligonucleotide
tatcgggaagaaagcaatccgctca

SEQ ID NO: 724725 - DNA, 25 bp, Artificial sequence
  Synthetic oligonucleotide
ctggcctatcgggaagaaagcaatc

SEQ ID NO: 724726 - DNA, 25 bp, Artificial sequence
  Synthetic oligonucleotide
cgtttggaaagcgatccgatcaaaa

SEQ ID NO: 724727 - DNA, 25 bp, Artificial sequence
  Synthetic oligonucleotide
cagctatgtcgccatggggaggtgg

SEQ ID NO: 724728 - DNA, 25 bp, Artificial sequence
  Synthetic oligonucleotide
agggaacgtctcagcgatgtccagg

SEQ ID NO: 724729 - DNA, 25 bp, Artificial sequence
  Synthetic oligonucleotide
cctgacagggaacgtctcagcgatg

SEQ ID NO: 724730 - DNA, 25 bp, Artificial sequence
  Synthetic oligonucleotide
atcacgcctgacagggaacgtctca

SEQ ID NO: 724731 - DNA, 25 bp, Artificial sequence
  Synthetic oligonucleotide
cagggcatcacgcctgacagggaac

SEQ ID NO: 724732 - DNA, 25 bp, Artificial sequence
  Synthetic oligonucleotide
ttgcagcagggcatcacgcctgaca

SEQ ID NO: 724733 - DNA, 25 bp, Artificial sequence
  Synthetic oligonucleotide
cctttgttgcagcagggcatcacgc

SEQ ID NO: 724734 - DNA, 25 bp, Artificial sequence
  Synthetic oligonucleotide
ttgaaacctttgttgcagcagggca

SEQ ID NO: 724735 - DNA, 25 bp, Artificial sequence
  Synthetic oligonucleotide
ctgttgttgaaacctttgttgcagc

SEQ ID NO: 724736 - DNA, 25 bp, Artificial sequence
  Synthetic oligonucleotide
atgaagctgttgttgaaacctttgt

SEQ ID NO: 724737 - DNA, 25 bp, Artificial sequence
  Synthetic oligonucleotide
gaattgatgaagctgttgttgaaac

SEQ ID NO: 724738 - DNA, 25 bp, Artificial sequence
  Synthetic oligonucleotide
gaggtggaattgatgaagctgttgt

SEQ ID NO: 724739 - DNA, 25 bp, Artificial sequence
  Synthetic oligonucleotide
cctctgaagtgatgatgcagtttcc

SEQ ID NO: 724740 - DNA, 25 bp, Artificial sequence
  Synthetic oligonucleotide
tgtcgccatggggaggtggaattga

SEQ ID NO: 724741 - DNA, 25 bp, Artificial sequence
  Synthetic oligonucleotide
tgtccaggtgcgagggtcggtgttt

SEQ ID NO: 724742 - DNA, 25 bp, Artificial sequence
  Synthetic oligonucleotide
gccgccagctatgtcgccatgggga

SEQ ID NO: 724743 - DNA, 25 bp, Artificial sequence
  Synthetic oligonucleotide
gggatggccgccagctatgtcgcca

SEQ ID NO: 724744 - DNA, 25 bp, Artificial sequence
  Synthetic oligonucleotide
ggccagcgggatggccgccagctat

SEQ ID NO: 724745 - DNA, 25 bp, Artificial sequence
  Synthetic oligonucleotide
agcgtggccagcgggatggccgcca

SEQ ID NO: 724746 - DNA, 25 bp, Artificial sequence
  Synthetic oligonucleotide
accgccagcgtggccagcgggatgg

SEQ ID NO: 724747 - DNA, 25 bp, Artificial sequence
  Synthetic oligonucleotide
tatgacaccgccagcgtggccagcg

SEQ ID NO: 724748 - DNA, 25 bp, Artificial sequence
  Synthetic oligonucleotide
acggctatgacaccgccagcgtggc

SEQ ID NO: 724749 - DNA, 25 bp, Artificial sequence
  Synthetic oligonucleotide
ctggtacggctatgacaccgccagc

SEQ ID NO: 724750 - DNA, 25 bp, Artificial sequence
  Synthetic oligonucleotide
gttttcctggtacggctatgacacc

SEQ ID NO: 724751 - DNA, 25 bp, Artificial sequence
  Synthetic oligonucleotide
aacgctgttttcctggtacggctat

SEQ ID NO: 724752 - DNA, 25 bp, Artificial sequence
  Synthetic oligonucleotide
cggtcaccgaaacgctgttttcctg

SEQ ID NO: 724753 - DNA, 25 bp, Artificial sequence
  Synthetic oligonucleotide
cgatgtcggtcaccgaaacgctgtt

SEQ ID NO: 724754 - DNA, 25 bp, Artificial sequence
  Synthetic oligonucleotide
catggggaggtggaattgatgaagc

SEQ ID NO: 724755 - DNA, 25 bp, Artificial sequence
  Synthetic oligonucleotide
tacctgcctccggaggcataccatg

SEQ ID NO: 724756 - DNA, 25 bp, Artificial sequence
  Synthetic oligonucleotide
ggcgtcagccctgtggttccgaact

SEQ ID NO: 724757 - DNA, 25 bp, Artificial sequence
  Synthetic oligonucleotide
actacatccaccaggtgacctctga

SEQ ID NO: 724758 - DNA, 25 bp, Artificial sequence
  Synthetic oligonucleotide
tacctgcactacatccaccaggtga

SEQ ID NO: 724759 - DNA, 25 bp, Artificial sequence
  Synthetic oligonucleotide
cgcctgtacctgcactacatccacc

SEQ ID NO: 724760 - DNA, 25 bp, Artificial sequence
  Synthetic oligonucleotide
ggcgaccgcctgtacctgcactaca

SEQ ID NO: 724761 - DNA, 25 bp, Artificial sequence
  Synthetic oligonucleotide
gtggacggcgaccgcctgtacctgc

SEQ ID NO: 724762 - DNA, 25 bp, Artificial sequence
  Synthetic oligonucleotide
gcttcgtggacggcgaccgcctgta

SEQ ID NO: 724763 - DNA, 25 bp, Artificial sequence
  Synthetic oligonucleotide
tattcgcttcgtggacggcgaccgc

SEQ ID NO: 724764 - DNA, 25 bp, Artificial sequence
  Synthetic oligonucleotide
attgatattcgcttcgtggacggcg

SEQ ID NO: 724765 - DNA, 25 bp, Artificial sequence
  Synthetic oligonucleotide
ccattcattgatattcgcttcgtgg

SEQ ID NO: 724766 - DNA, 25 bp, Artificial sequence
  Synthetic oligonucleotide
gatacgccattcattgatattcgct

SEQ ID NO: 724767 - DNA, 25 bp, Artificial sequence
  Synthetic oligonucleotide
taccatgatacgccattcattgata

SEQ ID NO: 724768 - DNA, 25 bp, Artificial sequence
  Synthetic oligonucleotide
acgtctcagcgatgtccaggtgcga

SEQ ID NO: 724769 - DNA, 25 bp, Artificial sequence
  Synthetic oligonucleotide
cctccggaggcataccatgatacgc

SEQ ID NO: 724770 - DNA, 25 bp, Artificial sequence
  Synthetic oligonucleotide
cagcgatgtccaggtgcgagggtcg

SEQ ID NO: 724771 - DNA, 25 bp, Artificial sequence
  Synthetic oligonucleotide
tggggggtacctgcctccggaggca

SEQ ID NO: 724772 - DNA, 25 bp, Artificial sequence
  Synthetic oligonucleotide
gcagcctggggggtacctgcctccg

SEQ ID NO: 724773 - DNA, 25 bp, Artificial sequence
  Synthetic oligonucleotide
aagaatgcagcctggggggtacctg

SEQ ID NO: 724774 - DNA, 25 bp, Artificial sequence
  Synthetic oligonucleotide
tttcggaagaatgcagcctgggggg

SEQ ID NO: 724775 - DNA, 25 bp, Artificial sequence
  Synthetic oligonucleotide
tacgatttcggaagaatgcagcctg

SEQ ID NO: 724776 - DNA, 25 bp, Artificial sequence
  Synthetic oligonucleotide
gtcgaatacgatttcggaagaatgc

SEQ ID NO: 724777 - DNA, 25 bp, Artificial sequence
  Synthetic oligonucleotide
gatggcgtcgaatacgatttcggaa

SEQ ID NO: 724778 - DNA, 25 bp, Artificial sequence
  Synthetic oligonucleotide
atcctggatggcgtcgaatacgatt

SEQ ID NO: 724779 - DNA, 25 bp, Artificial sequence
  Synthetic oligonucleotide
gtgtttatcctggatggcgtcgaat

SEQ ID NO: 724780 - DNA, 25 bp, Artificial sequence
  Synthetic oligonucleotide
gggtcggtgtttatcctggatggcg

SEQ ID NO: 724781 - DNA, 25 bp, Artificial sequence
  Synthetic oligonucleotide
gtgcgagggtcggtgtttatcctgg

SEQ ID NO: 724782 - DNA, 25 bp, Artificial sequence
  Synthetic oligonucleotide
aggtgacctctgaagtgatgatgca

SEQ ID NO: 724783 - DNA, 25 bp, Artificial sequence
  Synthetic oligonucleotide
gaggcataccatgatacgccattca

SEQ ID NO: 724784 - DNA, 25 bp, Artificial sequence
  Synthetic oligonucleotide
tgaagtgctcaagcgtctcggcagc

SEQ ID NO: 724785 - DNA, 25 bp, Artificial sequence
  Synthetic oligonucleotide
aggccgccgagctgatcgtgatgaa

SEQ ID NO: 724786 - DNA, 25 bp, Artificial sequence
  Synthetic oligonucleotide
tggccgcggcgacccacattgccga

SEQ ID NO: 724787 - DNA, 25 bp, Artificial sequence
  Synthetic oligonucleotide
ttcagtctggccgcggcgacccaca

SEQ ID NO: 724788 - DNA, 25 bp, Artificial sequence
  Synthetic oligonucleotide
gacgagttcagtctggccgcggcga

SEQ ID NO: 724789 - DNA, 25 bp, Artificial sequence
  Synthetic oligonucleotide
gggctggacgagttcagtctggccg

SEQ ID NO: 724790 - DNA, 25 bp, Artificial sequence
  Synthetic oligonucleotide
cgcgacgggctggacgagttcagtc

SEQ ID NO: 724791 - DNA, 25 bp, Artificial sequence
  Synthetic oligonucleotide
cattcgcgcgacgggctggacgagt

SEQ ID NO: 724792 - DNA, 25 bp, Artificial sequence
  Synthetic oligonucleotide
gtggtgcattcgcgcgacgggctgg

SEQ ID NO: 724793 - DNA, 25 bp, Artificial sequence
  Synthetic oligonucleotide
gtgctggtggtgcattcgcgcgacg

SEQ ID NO: 724794 - DNA, 25 bp, Artificial sequence
  Synthetic oligonucleotide
gagcatgtgctggtggtgcattcgc

SEQ ID NO: 724795 - DNA, 25 bp, Artificial sequence
  Synthetic oligonucleotide
ggcagcgagcatgtgctggtggtgc

SEQ ID NO: 724796 - DNA, 25 bp, Artificial sequence
  Synthetic oligonucleotide
cccacattgccgagttgaaggacgg

SEQ ID NO: 724797 - DNA, 25 bp, Artificial sequence
  Synthetic oligonucleotide
gctcaagcgtctcggcagcgagcat

SEQ ID NO: 724798 - DNA, 25 bp, Artificial sequence
  Synthetic oligonucleotide
ttgccgagttgaaggacggcgaggt

SEQ ID NO: 724799 - DNA, 25 bp, Artificial sequence
  Synthetic oligonucleotide
gctggctgaagtgctcaagcgtctc

SEQ ID NO: 724800 - DNA, 25 bp, Artificial sequence
  Synthetic oligonucleotide
caagccgctggctgaagtgctcaag

SEQ ID NO: 724801 - DNA, 25 bp, Artificial sequence
  Synthetic oligonucleotide
actgtgcaagccgctggctgaagtg

SEQ ID NO: 724802 - DNA, 25 bp, Artificial sequence
  Synthetic oligonucleotide
ccaggaactgtgcaagccgctggct

SEQ ID NO: 724803 - DNA, 25 bp, Artificial sequence
  Synthetic oligonucleotide
tgttcacccaggaactgtgcaagcc

SEQ ID NO: 724804 - DNA, 25 bp, Artificial sequence
  Synthetic oligonucleotide
tcggggtgttcacccaggaactgtg

SEQ ID NO: 724805 - DNA, 25 bp, Artificial sequence
  Synthetic oligonucleotide
gcaccaggtggtcggggtgttcacc

SEQ ID NO: 724806 - DNA, 25 bp, Artificial sequence
  Synthetic oligonucleotide
gtcaggcaccaggtggtcggggtgt

SEQ ID NO: 724807 - DNA, 25 bp, Artificial sequence
  Synthetic oligonucleotide
gcgggagtcaggcaccaggtggtcg

SEQ ID NO: 724808 - DNA, 25 bp, Artificial sequence
  Synthetic oligonucleotide
caacccggcgggagtcaggcaccag

SEQ ID NO: 724809 - DNA, 25 bp, Artificial sequence
  Synthetic oligonucleotide
actgaccaacccggcgggagtcagg

SEQ ID NO: 724810 - DNA, 25 bp, Artificial sequence
  Synthetic oligonucleotide
tggcccactgaccaacccggcggga

SEQ ID NO: 724811 - DNA, 25 bp, Artificial sequence
  Synthetic oligonucleotide
cgtctcggcagcgagcatgtgctgg

SEQ ID NO: 724812 - DNA, 25 bp, Artificial sequence
  Synthetic oligonucleotide
tggggctggaggtcgacagtccgca

SEQ ID NO: 724813 - DNA, 25 bp, Artificial sequence
  Synthetic oligonucleotide
tgccgaggcctaccgtttggaaagc

SEQ ID NO: 724814 - DNA, 25 bp, Artificial sequence
  Synthetic oligonucleotide
gaggctgggcagaaggccgccgagc

SEQ ID NO: 724815 - DNA, 25 bp, Artificial sequence
  Synthetic oligonucleotide
aagaccgaggctgggcagaaggccg

SEQ ID NO: 724816 - DNA, 25 bp, Artificial sequence
  Synthetic oligonucleotide
cggcgcaagaccgaggctgggcaga

SEQ ID NO: 724817 - DNA, 25 bp, Artificial sequence
  Synthetic oligonucleotide
ttggggcggcgcaagaccgaggctg

SEQ ID NO: 724818 - DNA, 25 bp, Artificial sequence
  Synthetic oligonucleotide
gacgctttggggcggcgcaagaccg

SEQ ID NO: 724819 - DNA, 25 bp, Artificial sequence
  Synthetic oligonucleotide
atccgcgacgctttggggcggcgca

SEQ ID NO: 724820 - DNA, 25 bp, Artificial sequence
  Synthetic oligonucleotide
gaactgatccgcgacgctttggggc

SEQ ID NO: 724821 - DNA, 25 bp, Artificial sequence
  Synthetic oligonucleotide
tcgctggaactgatccgcgacgctt

SEQ ID NO: 724822 - DNA, 25 bp, Artificial sequence
  Synthetic oligonucleotide
caggcctcgctggaactgatccgcg

SEQ ID NO: 724823 - DNA, 25 bp, Artificial sequence
  Synthetic oligonucleotide
gtccgcaggcctcgctggaactgat

SEQ ID NO: 724824 - DNA, 25 bp, Artificial sequence
  Synthetic oligonucleotide
cggcgacccacattgccgagttgaa

SEQ ID NO: 724825 - DNA, 25 bp, Artificial sequence
  Synthetic oligonucleotide
tggaggtcgacagtccgcaggcctc

SEQ ID NO: 724826 - DNA, 25 bp, Artificial sequence
  Synthetic oligonucleotide
ggactctgttcaacatgcttggccc

SEQ ID NO: 724827 - DNA, 25 bp, Artificial sequence
  Synthetic oligonucleotide
ccctgatggggctggaggtcgacag

SEQ ID NO: 724828 - DNA, 25 bp, Artificial sequence
  Synthetic oligonucleotide
gccagaccctgatggggctggaggt

SEQ ID NO: 724829 - DNA, 25 bp, Artificial sequence
  Synthetic oligonucleotide
tcaagagccagaccctgatggggct

SEQ ID NO: 724830 - DNA, 25 bp, Artificial sequence
  Synthetic oligonucleotide
tcgggatcaagagccagaccctgat

SEQ ID NO: 724831 - DNA, 25 bp, Artificial sequence
  Synthetic oligonucleotide
aggacttcgggatcaagagccagac

SEQ ID NO: 724832 - DNA, 25 bp, Artificial sequence
  Synthetic oligonucleotide
gtcccgaggacttcgggatcaagag

SEQ ID NO: 724833 - DNA, 25 bp, Artificial sequence
  Synthetic oligonucleotide
aagtgcgtcccgaggacttcgggat

SEQ ID NO: 724834 - DNA, 25 bp, Artificial sequence
  Synthetic oligonucleotide
agtacgaagtgcgtcccgaggactt

SEQ ID NO: 724835 - DNA, 25 bp, Artificial sequence
  Synthetic oligonucleotide
tacgcgagtacgaagtgcgtcccga

SEQ ID NO: 724836 - DNA, 25 bp, Artificial sequence
  Synthetic oligonucleotide
gcgaggtacgcgagtacgaagtgcg

SEQ ID NO: 724837 - DNA, 25 bp, Artificial sequence
  Synthetic oligonucleotide
aggacggcgaggtacgcgagtacga

SEQ ID NO: 724838 - DNA, 25 bp, Artificial sequence
  Synthetic oligonucleotide
agttgaaggacggcgaggtacgcga

SEQ ID NO: 724839 - DNA, 25 bp, Artificial sequence
  Synthetic oligonucleotide
tcgacagtccgcaggcctcgctgga

SEQ ID NO: 724840 - DNA, 25 bp, Artificial sequence
  Synthetic oligonucleotide
gcgatggcgcgaacatcttcaacgt

SEQ ID NO: 724841 - DNA, 25 bp, Artificial sequence
  Synthetic oligonucleotide
tccggcaagagcggcagcgccgact

SEQ ID NO: 724842 - DNA, 25 bp, Artificial sequence
  Synthetic oligonucleotide
gcggtctccggcaagagcggcagcg

SEQ ID NO: 724843 - DNA, 25 bp, Artificial sequence
  Synthetic oligonucleotide
aaccgcgcggtctccggcaagagcg

SEQ ID NO: 724844 - DNA, 25 bp, Artificial sequence
  Synthetic oligonucleotide
cacggtaaccgcgcggtctccggca

SEQ ID NO: 724845 - DNA, 25 bp, Artificial sequence
  Synthetic oligonucleotide
gctggcggcaaggtcgccaaacacg

SEQ ID NO: 724846 - DNA, 25 bp, Artificial sequence
  Synthetic oligonucleotide
gccgccgctggcggcaaggtcgcca

SEQ ID NO: 724847 - DNA, 25 bp, Artificial sequence
  Synthetic oligonucleotide
cgtggtcgccgccgctggcggcaag

SEQ ID NO: 724848 - DNA, 25 bp, Artificial sequence
  Synthetic oligonucleotide
gtccttcgtggtcgccgccgctggc

SEQ ID NO: 724849 - DNA, 25 bp, Artificial sequence
  Synthetic oligonucleotide
ggcggcgtccttcgtggtcgccgcc

SEQ ID NO: 724850 - DNA, 25 bp, Artificial sequence
  Synthetic oligonucleotide
gtcctcggcggcgtccttcgtggtc

SEQ ID NO: 724851 - DNA, 25 bp, Artificial sequence
  Synthetic oligonucleotide
tcaacgtgtcctcggcggcgtcctt

SEQ ID NO: 724852 - DNA, 25 bp, Artificial sequence
  Synthetic oligonucleotide
acatgcttggcccactgaccaaccc

SEQ ID NO: 724853 - DNA, 25 bp, Artificial sequence
  Synthetic oligonucleotide
gcgcgaacatcttcaacgtgtcctc

SEQ ID NO: 724854 - DNA, 25 bp, Artificial sequence
  Synthetic oligonucleotide
gccgacttgctggaagccgccggca

SEQ ID NO: 724855 - DNA, 25 bp, Artificial sequence
  Synthetic oligonucleotide
ccggcggcgatggcgcgaacatctt

SEQ ID NO: 724856 - DNA, 25 bp, Artificial sequence
  Synthetic oligonucleotide
tcggcaccggcggcgatggcgcgaa

SEQ ID NO: 724857 - DNA, 25 bp, Artificial sequence
  Synthetic oligonucleotide
acgtggtcggcaccggcggcgatgg

SEQ ID NO: 724858 - DNA, 25 bp, Artificial sequence
  Synthetic oligonucleotide
tggtcgacgtggtcggcaccggcgg

SEQ ID NO: 724859 - DNA, 25 bp, Artificial sequence
  Synthetic oligonucleotide
agcatgtggtcgacgtggtcggcac

SEQ ID NO: 724860 - DNA, 25 bp, Artificial sequence
  Synthetic oligonucleotide
cgctgaagcatgtggtcgacgtggt

SEQ ID NO: 724861 - DNA, 25 bp, Artificial sequence
  Synthetic oligonucleotide
tgcctacgctgaagcatgtggtcga

SEQ ID NO: 724862 - DNA, 25 bp, Artificial sequence
  Synthetic oligonucleotide
tgcagttgcctacgctgaagcatgt

SEQ ID NO: 724863 - DNA, 25 bp, Artificial sequence
  Synthetic oligonucleotide
acggcgtgcagttgcctacgctgaa

SEQ ID NO: 724864 - DNA, 25 bp, Artificial sequence
  Synthetic oligonucleotide
tggccgacggcgtgcagttgcctac

SEQ ID NO: 724865 - DNA, 25 bp, Artificial sequence
  Synthetic oligonucleotide
cgaactggccgacggcgtgcagttg

SEQ ID NO: 724866 - DNA, 25 bp, Artificial sequence
  Synthetic oligonucleotide
gatgcgcgaactggccgacggcgtg

SEQ ID NO: 724867 - DNA, 25 bp, Artificial sequence
  Synthetic oligonucleotide
acatcttcaacgtgtcctcggcggc

SEQ ID NO: 724868 - DNA, 25 bp, Artificial sequence
  Synthetic oligonucleotide
ccgtcggcgtcgggttcatgttcgc

SEQ ID NO: 724869 - DNA, 25 bp, Artificial sequence
  Synthetic oligonucleotide
ccgagctgatcgtgatgaatgccgg

SEQ ID NO: 724870 - DNA, 25 bp, Artificial sequence
  Synthetic oligonucleotide
gcttgcggactctgttcaacatgct

SEQ ID NO: 724871 - DNA, 25 bp, Artificial sequence
  Synthetic oligonucleotide
agctgggcttgcggactctgttcaa

SEQ ID NO: 724872 - DNA, 25 bp, Artificial sequence
  Synthetic oligonucleotide
gccgcgagctgggcttgcggactct

SEQ ID NO: 724873 - DNA, 25 bp, Artificial sequence
  Synthetic oligonucleotide
gtccgcgccgcgagctgggcttgcg

SEQ ID NO: 724874 - DNA, 25 bp, Artificial sequence
  Synthetic oligonucleotide
ccgccggtccgcgccgcgagctggg

SEQ ID NO: 724875 - DNA, 25 bp, Artificial sequence
  Synthetic oligonucleotide
agtacgccgccggtccgcgccgcga

SEQ ID NO: 724876 - DNA, 25 bp, Artificial sequence
  Synthetic oligonucleotide
cgatgaagtacgccgccggtccgcg

SEQ ID NO: 724877 - DNA, 25 bp, Artificial sequence
  Synthetic oligonucleotide
acaaggcgatgaagtacgccgccgg

SEQ ID NO: 724878 - DNA, 25 bp, Artificial sequence
  Synthetic oligonucleotide
tccaccacaaggcgatgaagtacgc

SEQ ID NO: 724879 - DNA, 25 bp, Artificial sequence
  Synthetic oligonucleotide
cccaggtccaccacaaggcgatgaa

SEQ ID NO: 724880 - DNA, 25 bp, Artificial sequence
  Synthetic oligonucleotide
tgttcgcccaggtccaccacaaggc

SEQ ID NO: 724881 - DNA, 25 bp, Artificial sequence
  Synthetic oligonucleotide
aagagcggcagcgccgacttgctgg

SEQ ID NO: 724882 - DNA, 25 bp, Artificial sequence
  Synthetic oligonucleotide
gcgtcgggttcatgttcgcccaggt

SEQ ID NO: 724883 - DNA, 25 bp, Artificial sequence
  Synthetic oligonucleotide
ggcagcgccgacttgctggaagccg

SEQ ID NO: 724884 - DNA, 25 bp, Artificial sequence
  Synthetic oligonucleotide
tcgacaccgtcggcgtcgggttcat

SEQ ID NO: 724885 - DNA, 25 bp, Artificial sequence
  Synthetic oligonucleotide
gttgcatcgacaccgtcggcgtcgg

SEQ ID NO: 724886 - DNA, 25 bp, Artificial sequence
  Synthetic oligonucleotide
tggcgcgttgcatcgacaccgtcgg

SEQ ID NO: 724887 - DNA, 25 bp, Artificial sequence
  Synthetic oligonucleotide
acaggtggcgcgttgcatcgacacc

SEQ ID NO: 724888 - DNA, 25 bp, Artificial sequence
  Synthetic oligonucleotide
ctccgaacaggtggcgcgttgcatc

SEQ ID NO: 724889 - DNA, 25 bp, Artificial sequence
  Synthetic oligonucleotide
gctgacctccgaacaggtggcgcgt

SEQ ID NO: 724890 - DNA, 25 bp, Artificial sequence
  Synthetic oligonucleotide
ctggagctgacctccgaacaggtgg

SEQ ID NO: 724891 - DNA, 25 bp, Artificial sequence
  Synthetic oligonucleotide
atctacctggagctgacctccgaac

SEQ ID NO: 724892 - DNA, 25 bp, Artificial sequence
  Synthetic oligonucleotide
gccggcatctacctggagctgacct

SEQ ID NO: 724893 - DNA, 25 bp, Artificial sequence
  Synthetic oligonucleotide
ggaagccgccggcatctacctggag

SEQ ID NO: 724894 - DNA, 25 bp, Artificial sequence
  Synthetic oligonucleotide
cttgctggaagccgccggcatctac

SEQ ID NO: 724895 - DNA, 25 bp, Artificial sequence
  Synthetic oligonucleotide
tgttcaacatgcttggcccactgac

SEQ ID NO: 724896 - DNA, 25 bp, Artificial sequence
  Synthetic oligonucleotide
ggttcatgttcgcccaggtccacca

SEQ ID NO: 724897 - DNA, 25 bp, Artificial sequence
  Synthetic oligonucleotide
acgaggcgggtggcgcggcgtgcct

SEQ ID NO: 724898 - DNA, 25 bp, Artificial sequence
  Synthetic oligonucleotide
ggcagaaggccgccgagctgatcgt

SEQ ID NO: 724899 - DNA, 25 bp, Artificial sequence
  Synthetic oligonucleotide
tctgaaggaagcgcgggccgcctgt

SEQ ID NO: 724900 - DNA, 25 bp, Artificial sequence
  Synthetic oligonucleotide
tgcctatctgaaggaagcgcgggcc

SEQ ID NO: 724901 - DNA, 25 bp, Artificial sequence
  Synthetic oligonucleotide
gccgatgcctatctgaaggaagcgc

SEQ ID NO: 724902 - DNA, 25 bp, Artificial sequence
  Synthetic oligonucleotide
cagggcgccgatgcctatctgaagg

SEQ ID NO: 724903 - DNA, 25 bp, Artificial sequence
  Synthetic oligonucleotide
tcttccagggcgccgatgcctatct

SEQ ID NO: 724904 - DNA, 25 bp, Artificial sequence
  Synthetic oligonucleotide
tggacttcttccagggcgccgatgc

SEQ ID NO: 724905 - DNA, 25 bp, Artificial sequence
  Synthetic oligonucleotide
cgacgtggacttcttccagggcgcc

SEQ ID NO: 724906 - DNA, 25 bp, Artificial sequence
  Synthetic oligonucleotide
tgctcaccgacgtggacttcttcca

SEQ ID NO: 724907 - DNA, 25 bp, Artificial sequence
  Synthetic oligonucleotide
tgtcggtgctcaccgacgtggactt

SEQ ID NO: 724908 - DNA, 25 bp, Artificial sequence
  Synthetic oligonucleotide
cgtgcctgtcggtgctcaccgacgt

SEQ ID NO: 724909 - DNA, 25 bp, Artificial sequence
  Synthetic oligonucleotide
gcgggccgcctgtgcgctgccggtg

SEQ ID NO: 724910 - DNA, 25 bp, Artificial sequence
  Synthetic oligonucleotide
gggtggcgcggcgtgcctgtcggtg

SEQ ID NO: 724911 - DNA, 25 bp, Artificial sequence
  Synthetic oligonucleotide
cgcctgtgcgctgccggtgatccgc

SEQ ID NO: 724912 - DNA, 25 bp, Artificial sequence
  Synthetic oligonucleotide
cagctacgaggcgggtggcgcggcg

SEQ ID NO: 724913 - DNA, 25 bp, Artificial sequence
  Synthetic oligonucleotide
cgcccgcagctacgaggcgggtggc

SEQ ID NO: 724914 - DNA, 25 bp, Artificial sequence
  Synthetic oligonucleotide
ggagatcgcccgcagctacgaggcg

SEQ ID NO: 724915 - DNA, 25 bp, Artificial sequence
  Synthetic oligonucleotide
tcccggcggagatcgcccgcagcta

SEQ ID NO: 724916 - DNA, 25 bp, Artificial sequence
  Synthetic oligonucleotide
acttcgtcccggcggagatcgcccg

SEQ ID NO: 724917 - DNA, 25 bp, Artificial sequence
  Synthetic oligonucleotide
gcgaacacttcgtcccggcggagat

SEQ ID NO: 724918 - DNA, 25 bp, Artificial sequence
  Synthetic oligonucleotide
gtgctgcgcgaacacttcgtcccgg

SEQ ID NO: 724919 - DNA, 25 bp, Artificial sequence
  Synthetic oligonucleotide
agggcgtgctgcgcgaacacttcgt

SEQ ID NO: 724920 - DNA, 25 bp, Artificial sequence
  Synthetic oligonucleotide
ccgagcaagggcgtgctgcgcgaac

SEQ ID NO: 724921 - DNA, 25 bp, Artificial sequence
  Synthetic oligonucleotide
gcatcgccgagcaagggcgtgctgc

SEQ ID NO: 724922 - DNA, 25 bp, Artificial sequence
  Synthetic oligonucleotide
aagaaggcatcgccgagcaagggcg

SEQ ID NO: 724923 - DNA, 25 bp, Artificial sequence
  Synthetic oligonucleotide
gagatcaagaaggcatcgccgagca

SEQ ID NO: 724924 - DNA, 25 bp, Artificial sequence
  Synthetic oligonucleotide
gcgcggcgtgcctgtcggtgctcac

SEQ ID NO: 724925 - DNA, 25 bp, Artificial sequence
  Synthetic oligonucleotide
gccgactgcatcctgctgatcgtct

SEQ ID NO: 724926 - DNA, 25 bp, Artificial sequence
  Synthetic oligonucleotide
gtctcgacgtactggtcgaagtgca

SEQ ID NO: 724927 - DNA, 25 bp, Artificial sequence
  Synthetic oligonucleotide
tcggtcggtctcgacgtactggtcg

SEQ ID NO: 724928 - DNA, 25 bp, Artificial sequence
  Synthetic oligonucleotide
tgccaagtcggtcggtctcgacgta

SEQ ID NO: 724929 - DNA, 25 bp, Artificial sequence
  Synthetic oligonucleotide
ggcgactgccaagtcggtcggtctc

SEQ ID NO: 724930 - DNA, 25 bp, Artificial sequence
  Synthetic oligonucleotide
actggcggcgactgccaagtcggtc

SEQ ID NO: 724931 - DNA, 25 bp, Artificial sequence
  Synthetic oligonucleotide
gccgaactggcggcgactgccaagt

SEQ ID NO: 724932 - DNA, 25 bp, Artificial sequence
  Synthetic oligonucleotide
ctgatggccgaactggcggcgactg

SEQ ID NO: 724933 - DNA, 25 bp, Artificial sequence
  Synthetic oligonucleotide
acgtgctgatggccgaactggcggc

SEQ ID NO: 724934 - DNA, 25 bp, Artificial sequence
  Synthetic oligonucleotide
tggacgacgtgctgatggccgaact

SEQ ID NO: 724935 - DNA, 25 bp, Artificial sequence
  Synthetic oligonucleotide
cggcgctggacgacgtgctgatggc

SEQ ID NO: 724936 - DNA, 25 bp, Artificial sequence
  Synthetic oligonucleotide
tcgtctcggcgctggacgacgtgct

SEQ ID NO: 724937 - DNA, 25 bp, Artificial sequence
  Synthetic oligonucleotide
ggaagcgcgggccgcctgtgcgctg

SEQ ID NO: 724938 - DNA, 25 bp, Artificial sequence
  Synthetic oligonucleotide
tgcatcctgctgatcgtctcggcgc

SEQ ID NO: 724939 - DNA, 25 bp, Artificial sequence
  Synthetic oligonucleotide
gagccggcagtgatcgccgagatca

SEQ ID NO: 724940 - DNA, 25 bp, Artificial sequence
  Synthetic oligonucleotide
tcggtgccgactgcatcctgctgat

SEQ ID NO: 724941 - DNA, 25 bp, Artificial sequence
  Synthetic oligonucleotide
gggcgatcggtgccgactgcatcct

SEQ ID NO: 724942 - DNA, 25 bp, Artificial sequence
  Synthetic oligonucleotide
aggcgcgggcgatcggtgccgactg

SEQ ID NO: 724943 - DNA, 25 bp, Artificial sequence
  Synthetic oligonucleotide
tcgtcgaggcgcgggcgatcggtgc

SEQ ID NO: 724944 - DNA, 25 bp, Artificial sequence
  Synthetic oligonucleotide
accagatcgtcgaggcgcgggcgat

SEQ ID NO: 724945 - DNA, 25 bp, Artificial sequence
  Synthetic oligonucleotide
atccgtaccagatcgtcgaggcgcg

SEQ ID NO: 724946 - DNA, 25 bp, Artificial sequence
  Synthetic oligonucleotide
gatcgatccgtaccagatcgtcgag

SEQ ID NO: 724947 - DNA, 25 bp, Artificial sequence
  Synthetic oligonucleotide
cttcatgatcgatccgtaccagatc

SEQ ID NO: 724948 - DNA, 25 bp, Artificial sequence
  Synthetic oligonucleotide
caaggacttcatgatcgatccgtac

SEQ ID NO: 724949 - DNA, 25 bp, Artificial sequence
  Synthetic oligonucleotide
gatccgcaaggacttcatgatcgat

SEQ ID NO: 724950 - DNA, 25 bp, Artificial sequence
  Synthetic oligonucleotide
gccggtgatccgcaaggacttcatg

SEQ ID NO: 724951 - DNA, 25 bp, Artificial sequence
  Synthetic oligonucleotide
tgcgctgccggtgatccgcaaggac

SEQ ID NO: 724952 - DNA, 25 bp, Artificial sequence
  Synthetic oligonucleotide
ctgctgatcgtctcggcgctggacg

SEQ ID NO: 724953 - DNA, 25 bp, Artificial sequence
  Synthetic oligonucleotide
tggcccacgatgccctgcacaccgg

SEQ ID NO: 724954 - DNA, 25 bp, Artificial sequence
  Synthetic oligonucleotide
gagaacgcacagtgagtgtgccgac

SEQ ID NO: 724955 - DNA, 25 bp, Artificial sequence
  Synthetic oligonucleotide
cagagaggagaacgcacagtgagtg

SEQ ID NO: 724956 - DNA, 25 bp, Artificial sequence
  Synthetic oligonucleotide
gtttacagagaggagaacgcacagt

SEQ ID NO: 724957 - DNA, 25 bp, Artificial sequence
  Synthetic oligonucleotide
accgccgtttacagagaggagaacg

SEQ ID NO: 724958 - DNA, 25 bp, Artificial sequence
  Synthetic oligonucleotide
gccttcaccgccgtttacagagagg

SEQ ID NO: 724959 - DNA, 25 bp, Artificial sequence
  Synthetic oligonucleotide
ctggtggccttcaccgccgtttaca

SEQ ID NO: 724960 - DNA, 25 bp, Artificial sequence
  Synthetic oligonucleotide
tggacgaactggtggccttcaccgc

SEQ ID NO: 724961 - DNA, 25 bp, Artificial sequence
  Synthetic oligonucleotide
agaagatggacgaactggtggcctt

SEQ ID NO: 724962 - DNA, 25 bp, Artificial sequence
  Synthetic oligonucleotide
cacgggagaagatggacgaactggt

SEQ ID NO: 724963 - DNA, 25 bp, Artificial sequence
  Synthetic oligonucleotide
ggctggcacgggagaagatggacga

SEQ ID NO: 724964 - DNA, 25 bp, Artificial sequence
  Synthetic oligonucleotide
acaccgggctggcacgggagaagat

SEQ ID NO: 724965 - DNA, 25 bp, Artificial sequence
  Synthetic oligonucleotide
atcgccgagatcaagaaggcatcgc

SEQ ID NO: 724966 - DNA, 25 bp, Artificial sequence
  Synthetic oligonucleotide
acgatgccctgcacaccgggctggc

SEQ ID NO: 724967 - DNA, 25 bp, Artificial sequence
  Synthetic oligonucleotide
tgccgacggttctgcagaagatcct

SEQ ID NO: 724968 - DNA, 25 bp, Artificial sequence
  Synthetic oligonucleotide
attcaactggcccacgatgccctgc

SEQ ID NO: 724969 - DNA, 25 bp, Artificial sequence
  Synthetic oligonucleotide
cgagggcattcaactggcccacgat

SEQ ID NO: 724970 - DNA, 25 bp, Artificial sequence
  Synthetic oligonucleotide
gcctgcacgagggcattcaactggc

SEQ ID NO: 724971 - DNA, 25 bp, Artificial sequence
  Synthetic oligonucleotide
cgaccagcctgcacgagggcattca

SEQ ID NO: 724972 - DNA, 25 bp, Artificial sequence
  Synthetic oligonucleotide
atctggcgaccagcctgcacgaggg

SEQ ID NO: 724973 - DNA, 25 bp, Artificial sequence
  Synthetic oligonucleotide
tgccgatctggcgaccagcctgcac

SEQ ID NO: 724974 - DNA, 25 bp, Artificial sequence
  Synthetic oligonucleotide
gtacgctgccgatctggcgaccagc

SEQ ID NO: 724975 - DNA, 25 bp, Artificial sequence
  Synthetic oligonucleotide
gcactgtacgctgccgatctggcga

SEQ ID NO: 724976 - DNA, 25 bp, Artificial sequence
  Synthetic oligonucleotide
gcccggcactgtacgctgccgatct

SEQ ID NO: 724977 - DNA, 25 bp, Artificial sequence
  Synthetic oligonucleotide
atgccggcccggcactgtacgctgc

SEQ ID NO: 724978 - DNA, 25 bp, Artificial sequence
  Synthetic oligonucleotide
tgatgaatgccggcccggcactgta

SEQ ID NO: 724979 - DNA, 25 bp, Artificial sequence
  Synthetic oligonucleotide
tgatcgtgatgaatgccggcccggc

SEQ ID NO: 724980 - DNA, 25 bp, Artificial sequence
  Synthetic oligonucleotide
ccctgcacaccgggctggcacggga

SEQ ID NO: 724981 - DNA, 25 bp, Artificial sequence
  Synthetic oligonucleotide
ctggcagaggtcgagcggctggcgc

SEQ ID NO: 724982 - DNA, 25 bp, Artificial sequence
  Synthetic oligonucleotide
cgtcggcgcggtggcggtgatgcgc

SEQ ID NO: 724983 - DNA, 25 bp, Artificial sequence
  Synthetic oligonucleotide
gcgcaaggagccggcagtgatcgcc

SEQ ID NO: 724984 - DNA, 25 bp, Artificial sequence
  Synthetic oligonucleotide
ggccaagcgcaaggagccggcagtg

SEQ ID NO: 724985 - DNA, 25 bp, Artificial sequence
  Synthetic oligonucleotide
ggagcgggccaagcgcaaggagccg

SEQ ID NO: 724986 - DNA, 25 bp, Artificial sequence
  Synthetic oligonucleotide
cctgctggagcgggccaagcgcaag

SEQ ID NO: 724987 - DNA, 25 bp, Artificial sequence
  Synthetic oligonucleotide
caatgccctgctggagcgggccaag

SEQ ID NO: 724988 - DNA, 25 bp, Artificial sequence
  Synthetic oligonucleotide
cttcgccaatgccctgctggagcgg

SEQ ID NO: 724989 - DNA, 25 bp, Artificial sequence
  Synthetic oligonucleotide
gcgcggcttcgccaatgccctgctg

SEQ ID NO: 724990 - DNA, 25 bp, Artificial sequence
  Synthetic oligonucleotide
tgcgccgcgcggcttcgccaatgcc

SEQ ID NO: 724991 - DNA, 25 bp, Artificial sequence
  Synthetic oligonucleotide
cgccgatgcgccgcgcggcttcgcc

SEQ ID NO: 724992 - DNA, 25 bp, Artificial sequence
  Synthetic oligonucleotide
gcgtagcgccgatgcgccgcgcggc

SEQ ID NO: 724993 - DNA, 25 bp, Artificial sequence
  Synthetic oligonucleotide
gctggcgcgtagcgccgatgcgccg

SEQ ID NO: 724994 - DNA, 25 bp, Artificial sequence
  Synthetic oligonucleotide
gcacagtgagtgtgccgacggttct

SEQ ID NO: 724995 - DNA, 25 bp, Artificial sequence
  Synthetic oligonucleotide
gaggtcgagcggctggcgcgtagcg

SEQ ID NO: 724996 - DNA, 25 bp, Artificial sequence
  Synthetic oligonucleotide
tgagtgtgccgacggttctgcagaa

SEQ ID NO: 724997 - DNA, 25 bp, Artificial sequence
  Synthetic oligonucleotide
tcaacctggcagaggtcgagcggct

SEQ ID NO: 724998 - DNA, 25 bp, Artificial sequence
  Synthetic oligonucleotide
cgcgcgtcaacctggcagaggtcga

SEQ ID NO: 724999 - DNA, 25 bp, Artificial sequence
  Synthetic oligonucleotide
gccgtgcgcgcgtcaacctggcaga

SEQ ID NO: 725000 - DNA, 25 bp, Artificial sequence
  Synthetic oligonucleotide
ccgagcgccgtgcgcgcgtcaacct

SEQ ID NO: 725001 - DNA, 25 bp, Artificial sequence
  Synthetic oligonucleotide
aggtcgccgagcgccgtgcgcgcgt

SEQ ID NO: 725002 - DNA, 25 bp, Artificial sequence
  Synthetic oligonucleotide
ccgaggaggtcgccgagcgccgtgc

SEQ ID NO: 725003 - DNA, 25 bp, Artificial sequence
  Synthetic oligonucleotide
gcaaggccgaggaggtcgccgagcg

SEQ ID NO: 725004 - DNA, 25 bp, Artificial sequence
  Synthetic oligonucleotide
tcgcccgcaaggccgaggaggtcgc

SEQ ID NO: 725005 - DNA, 25 bp, Artificial sequence
  Synthetic oligonucleotide
gatcctcgcccgcaaggccgaggag

SEQ ID NO: 725006 - DNA, 25 bp, Artificial sequence
  Synthetic oligonucleotide
tgcagaagatcctcgcccgcaaggc

SEQ ID NO: 725007 - DNA, 25 bp, Artificial sequence
  Synthetic oligonucleotide
cggttctgcagaagatcctcgcccg

SEQ ID NO: 725008 - DNA, 25 bp, Artificial sequence
  Synthetic oligonucleotide
gcagtgatcgccgagatcaagaagg

SEQ ID NO: 725009 - DNA, 25 bp, Artificial sequence
  Synthetic oligonucleotide
gagcggctggcgcgtagcgccgatg

SEQ ID NO: 725010 - DNA, 25 bp, Artificial sequence
  Synthetic oligonucleotide
cccgttggcgctggcgcgcctgact

SEQ ID NO: 725011 - DNA, 25 bp, Artificial sequence
  Synthetic oligonucleotide
ggcggtgatgcgcgaactggccgac

SEQ ID NO: 725012 - DNA, 25 bp, Artificial sequence
  Synthetic oligonucleotide
ataatgccgacgatccactccccct

SEQ ID NO: 725013 - DNA, 25 bp, Artificial sequence
  Synthetic oligonucleotide
acaggcataatgccgacgatccact

SEQ ID NO: 725014 - DNA, 25 bp, Artificial sequence
  Synthetic oligonucleotide
ttttccacaggcataatgccgacga

SEQ ID NO: 725015 - DNA, 25 bp, Artificial sequence
  Synthetic oligonucleotide
accccgttttccacaggcataatgc

SEQ ID NO: 725016 - DNA, 25 bp, Artificial sequence
  Synthetic oligonucleotide
ctgcgtaccccgttttccacaggca

SEQ ID NO: 725017 - DNA, 25 bp, Artificial sequence
  Synthetic oligonucleotide
cggtcacgtctccctgcgtaccccg

SEQ ID NO: 725018 - DNA, 25 bp, Artificial sequence
  Synthetic oligonucleotide
gcctggccggtcacgtctccctgcg

SEQ ID NO: 725019 - DNA, 25 bp, Artificial sequence
  Synthetic oligonucleotide
tcgccggcctggccggtcacgtctc

SEQ ID NO: 725020 - DNA, 25 bp, Artificial sequence
  Synthetic oligonucleotide
tcttcttcgccggcctggccggtca

SEQ ID NO: 725021 - DNA, 25 bp, Artificial sequence
  Synthetic oligonucleotide
ctgacttcttcttcgccggcctggc

SEQ ID NO: 725022 - DNA, 25 bp, Artificial sequence
  Synthetic oligonucleotide
gatccactcccccttcctccgcgag

SEQ ID NO: 725023 - DNA, 25 bp, Artificial sequence
  Synthetic oligonucleotide
gcgctggcgcgcctgacttcttctt

SEQ ID NO: 725024 - DNA, 25 bp, Artificial sequence
  Synthetic oligonucleotide
ctcccccttcctccgcgagcgcgcc

SEQ ID NO: 725025 - DNA, 25 bp, Artificial sequence
  Synthetic oligonucleotide
cattcgcccgttggcgctggcgcgc

SEQ ID NO: 725026 - DNA, 25 bp, Artificial sequence
  Synthetic oligonucleotide
tcaaggcattcgcccgttggcgctg

SEQ ID NO: 725027 - DNA, 25 bp, Artificial sequence
  Synthetic oligonucleotide
cctcatcaaggcattcgcccgttgg

SEQ ID NO: 725028 - DNA, 25 bp, Artificial sequence
  Synthetic oligonucleotide
tcacctccctcatcaaggcattcgc

SEQ ID NO: 725029 - DNA, 25 bp, Artificial sequence
  Synthetic oligonucleotide
gcatcatcacctccctcatcaaggc

SEQ ID NO: 725030 - DNA, 25 bp, Artificial sequence
  Synthetic oligonucleotide
tcagcagcatcatcacctccctcat

SEQ ID NO: 725031 - DNA, 25 bp, Artificial sequence
  Synthetic oligonucleotide
tccacctcagcagcatcatcacctc

SEQ ID NO: 725032 - DNA, 25 bp, Artificial sequence
  Synthetic oligonucleotide
tcgtgatccacctcagcagcatcat

SEQ ID NO: 725033 - DNA, 25 bp, Artificial sequence
  Synthetic oligonucleotide
ccgctatcgtgatccacctcagcag

SEQ ID NO: 725034 - DNA, 25 bp, Artificial sequence
  Synthetic oligonucleotide
gtgagaccgctatcgtgatccacct

SEQ ID NO: 725035 - DNA, 25 bp, Artificial sequence
  Synthetic oligonucleotide
ggctccgtgagaccgctatcgtgat

SEQ ID NO: 725036 - DNA, 25 bp, Artificial sequence
  Synthetic oligonucleotide
caacatggctccgtgagaccgctat

SEQ ID NO: 725037 - DNA, 25 bp, Artificial sequence
  Synthetic oligonucleotide
gcgcgcctgacttcttcttcgccgg

SEQ ID NO: 725038 - DNA, 25 bp, Artificial sequence
  Synthetic oligonucleotide
gttacagccagcatgctgctgatga

SEQ ID NO: 725039 - DNA, 25 bp, Artificial sequence
  Synthetic oligonucleotide
aaggccgaggtcaaggtggtgcgta

SEQ ID NO: 725040 - DNA, 25 bp, Artificial sequence
  Synthetic oligonucleotide
gagctcaaggccgaggtcaaggtgg

SEQ ID NO: 725041 - DNA, 25 bp, Artificial sequence
  Synthetic oligonucleotide
ttcggcgagctcaaggccgaggtca

SEQ ID NO: 725042 - DNA, 25 bp, Artificial sequence
  Synthetic oligonucleotide
cagtacttcggcgagctcaaggccg

SEQ ID NO: 725043 - DNA, 25 bp, Artificial sequence
  Synthetic oligonucleotide
cctggtgcagtacttcggcgagctc

SEQ ID NO: 725044 - DNA, 25 bp, Artificial sequence
  Synthetic oligonucleotide
ctacaacctggtgcagtacttcggc

SEQ ID NO: 725045 - DNA, 25 bp, Artificial sequence
  Synthetic oligonucleotide
cttcacctacaacctggtgcagtac

SEQ ID NO: 725046 - DNA, 25 bp, Artificial sequence
  Synthetic oligonucleotide
cgactccttcacctacaacctggtg

SEQ ID NO: 725047 - DNA, 25 bp, Artificial sequence
  Synthetic oligonucleotide
taactacgactccttcacctacaac

SEQ ID NO: 725048 - DNA, 25 bp, Artificial sequence
  Synthetic oligonucleotide
gatcgataactacgactccttcacc

SEQ ID NO: 725049 - DNA, 25 bp, Artificial sequence
  Synthetic oligonucleotide
ctgatgatcgataactacgactcct

SEQ ID NO: 725050 - DNA, 25 bp, Artificial sequence
  Synthetic oligonucleotide
gccgacgatccactcccccttcctc

SEQ ID NO: 725051 - DNA, 25 bp, Artificial sequence
  Synthetic oligonucleotide
gccagcatgctgctgatgatcgata

SEQ ID NO: 725052 - DNA, 25 bp, Artificial sequence
  Synthetic oligonucleotide
cactgggctatgttccccaacatgg

SEQ ID NO: 725053 - DNA, 25 bp, Artificial sequence
  Synthetic oligonucleotide
caagaggttacagccagcatgctgc

SEQ ID NO: 725054 - DNA, 25 bp, Artificial sequence
  Synthetic oligonucleotide
tgaaatcaagaggttacagccagca

SEQ ID NO: 725055 - DNA, 25 bp, Artificial sequence
  Synthetic oligonucleotide
taggaatgaaatcaagaggttacag

SEQ ID NO: 725056 - DNA, 25 bp, Artificial sequence
  Synthetic oligonucleotide
ttcgcataggaatgaaatcaagagg

SEQ ID NO: 725057 - DNA, 25 bp, Artificial sequence
  Synthetic oligonucleotide
atgcgattcgcataggaatgaaatc

SEQ ID NO: 725058 - DNA, 25 bp, Artificial sequence
  Synthetic oligonucleotide
cgggtgatgcgattcgcataggaat

SEQ ID NO: 725059 - DNA, 25 bp, Artificial sequence
  Synthetic oligonucleotide
aaagccgggtgatgcgattcgcata

SEQ ID NO: 725060 - DNA, 25 bp, Artificial sequence
  Synthetic oligonucleotide
gtggcgaaagccgggtgatgcgatt

SEQ ID NO: 725061 - DNA, 25 bp, Artificial sequence
  Synthetic oligonucleotide
acgggtgtggcgaaagccgggtgat

SEQ ID NO: 725062 - DNA, 25 bp, Artificial sequence
  Synthetic oligonucleotide
gcgcgccgggaaacgggtgtggcga

SEQ ID NO: 725063 - DNA, 25 bp, Artificial sequence
  Synthetic oligonucleotide
cgcgagcgcgccgggaaacgggtgt

SEQ ID NO: 725064 - DNA, 25 bp, Artificial sequence
  Synthetic oligonucleotide
cttcctccgcgagcgcgccgggaaa

SEQ ID NO: 725065 - DNA, 25 bp, Artificial sequence
  Synthetic oligonucleotide
atgctgctgatgatcgataactacg

SEQ ID NO: 725066 - DNA, 25 bp, Artificial sequence
  Synthetic oligonucleotide
gaaagcgatccgatcaaaacggaag

SEQ ID NO: 725067 - DNA, 25 bp, Artificial sequence
  Synthetic oligonucleotide
ccaaggtcgaagagatcaaggctag

SEQ ID NO: 725068 - DNA, 25 bp, Artificial sequence
  Synthetic oligonucleotide
tggcttgccaaggtcgaagagatca

SEQ ID NO: 725069 - DNA, 25 bp, Artificial sequence
  Synthetic oligonucleotide
agcgcctggcttgccaaggtcgaag

SEQ ID NO: 725070 - DNA, 25 bp, Artificial sequence
  Synthetic oligonucleotide
gattacagcgcctggcttgccaagg

SEQ ID NO: 725071 - DNA, 25 bp, Artificial sequence
  Synthetic oligonucleotide
gagacggattacagcgcctggcttg

SEQ ID NO: 725072 - DNA, 25 bp, Artificial sequence
  Synthetic oligonucleotide
ggtgtggagacggattacagcgcct

SEQ ID NO: 725073 - DNA, 25 bp, Artificial sequence
  Synthetic oligonucleotide
gtgcaggtgtggagacggattacag

SEQ ID NO: 725074 - DNA, 25 bp, Artificial sequence
  Synthetic oligonucleotide
cgatccgtgcaggtgtggagacgga

SEQ ID NO: 725075 - DNA, 25 bp, Artificial sequence
  Synthetic oligonucleotide
tcgattcgatccgtgcaggtgtgga

SEQ ID NO: 725076 - DNA, 25 bp, Artificial sequence
  Synthetic oligonucleotide
gtggagttcgattcgatccgtgcag

SEQ ID NO: 725077 - DNA, 25 bp, Artificial sequence
  Synthetic oligonucleotide
acggaagtggagttcgattcgatcc

SEQ ID NO: 725078 - DNA, 25 bp, Artificial sequence
  Synthetic oligonucleotide
gttccccaacatggctccgtgagac

SEQ ID NO: 725079 - DNA, 25 bp, Artificial sequence
  Synthetic oligonucleotide
gatccgatcaaaacggaagtggagt

SEQ ID NO: 725080 - DNA, 25 bp, Artificial sequence
  Synthetic oligonucleotide
aggctagatatccgctcccgcgcat

SEQ ID NO: 725081 - DNA, 25 bp, Artificial sequence
  Synthetic oligonucleotide
ggtgcgaccgctagcggccaagttt

SEQ ID NO: 725082 - DNA, 25 bp, Artificial sequence
  Synthetic oligonucleotide
gcctaccgtttggaaagcgatccga

SEQ ID NO: 725083 - DNA, 25 bp, Artificial sequence
  Synthetic oligonucleotide
ttccgcgacatcaacaaccagtggg

SEQ ID NO: 725084 - DNA, 25 bp, Artificial sequence
  Synthetic oligonucleotide
cagacgtgccgaggcctaccgtttg

SEQ ID NO: 725085 - DNA, 25 bp, Artificial sequence
  Synthetic oligonucleotide
gttggccagacgtgccgaggcctac

SEQ ID NO: 725086 - DNA, 25 bp, Artificial sequence
  Synthetic oligonucleotide
gctgtgttggccagacgtgccgagg

SEQ ID NO: 725087 - DNA, 25 bp, Artificial sequence
  Synthetic oligonucleotide
tatgatgctgtgttggccagacgtg

SEQ ID NO: 725088 - DNA, 25 bp, Artificial sequence
  Synthetic oligonucleotide
caagaatatgatgctgtgttggcca

SEQ ID NO: 725089 - DNA, 25 bp, Artificial sequence
  Synthetic oligonucleotide
gttcagcaagaatatgatgctgtgt

SEQ ID NO: 725090 - DNA, 25 bp, Artificial sequence
  Synthetic oligonucleotide
gagcgggttcagcaagaatatgatg

SEQ ID NO: 725091 - DNA, 25 bp, Artificial sequence
  Synthetic oligonucleotide
tccagagagcgggttcagcaagaat

SEQ ID NO: 725092 - DNA, 25 bp, Artificial sequence
  Synthetic oligonucleotide
tcaggtttccagagagcgggttcag

SEQ ID NO: 725093 - DNA, 25 bp, Artificial sequence
  Synthetic oligonucleotide
atcaaaacggaagtggagttcgatt

SEQ ID NO: 725094 - DNA, 25 bp, Artificial sequence
  Synthetic oligonucleotide
cgctactgtcgggcctctgcctggt

SEQ ID NO: 725095 - DNA, 25 bp, Artificial sequence
  Synthetic oligonucleotide
tgcgtaacgacgaactgagcgtgga

SEQ ID NO: 725096 - DNA, 25 bp, Artificial sequence
  Synthetic oligonucleotide
cctccccactgggctatgttcccca

SEQ ID NO: 725097 - DNA, 25 bp, Artificial sequence
  Synthetic oligonucleotide
acccatcctccccactgggctatgt

SEQ ID NO: 725098 - DNA, 25 bp, Artificial sequence
  Synthetic oligonucleotide
tgttgcacccatcctccccactggg

SEQ ID NO: 725099 - DNA, 25 bp, Artificial sequence
  Synthetic oligonucleotide
tcccgctgttgcacccatcctcccc

SEQ ID NO: 725100 - DNA, 25 bp, Artificial sequence
  Synthetic oligonucleotide
ccgacatcccgctgttgcacccatc

SEQ ID NO: 725101 - DNA, 25 bp, Artificial sequence
  Synthetic oligonucleotide
tttcttccgacatcccgctgttgca

SEQ ID NO: 725102 - DNA, 25 bp, Artificial sequence
  Synthetic oligonucleotide
agcctctttcttccgacatcccgct

SEQ ID NO: 725103 - DNA, 25 bp, Artificial sequence
  Synthetic oligonucleotide
ttcttaagcctctttcttccgacat

SEQ ID NO: 725104 - DNA, 25 bp, Artificial sequence
  Synthetic oligonucleotide
ttccgcttcttaagcctctttcttc

SEQ ID NO: 725105 - DNA, 25 bp, Artificial sequence
  Synthetic oligonucleotide
aacaatttccgcttcttaagcctct

SEQ ID NO: 725106 - DNA, 25 bp, Artificial sequence
  Synthetic oligonucleotide
tgcctggtaaacaatttccgcttct

SEQ ID NO: 725107 - DNA, 25 bp, Artificial sequence
  Synthetic oligonucleotide
tcgaagagatcaaggctagatatcc

SEQ ID NO: 725108 - DNA, 25 bp, Artificial sequence
  Synthetic oligonucleotide
tgtcgggcctctgcctggtaaacaa

SEQ ID NO: 725109 - DNA, 25 bp, Artificial sequence
  Synthetic oligonucleotide
agatcaaggctagatatccgctccc

SEQ ID NO: 725110 - DNA, 25 bp, Artificial sequence
  Synthetic oligonucleotide
ttagatcgctactgtcgggcctctg

SEQ ID NO: 725111 - DNA, 25 bp, Artificial sequence
  Synthetic oligonucleotide
gccattttagatcgctactgtcggg

SEQ ID NO: 725112 - DNA, 25 bp, Artificial sequence
  Synthetic oligonucleotide
ggcttcgccattttagatcgctact

SEQ ID NO: 725113 - DNA, 25 bp, Artificial sequence
  Synthetic oligonucleotide
cgtgtaggcttcgccattttagatc

SEQ ID NO: 725114 - DNA, 25 bp, Artificial sequence
  Synthetic oligonucleotide
ctgcctcgtgtaggcttcgccattt

SEQ ID NO: 725115 - DNA, 25 bp, Artificial sequence
  Synthetic oligonucleotide
gcaagcctgcctcgtgtaggcttcg

SEQ ID NO: 725116 - DNA, 25 bp, Artificial sequence
  Synthetic oligonucleotide
tggacgcaagcctgcctcgtgtagg

SEQ ID NO: 725117 - DNA, 25 bp, Artificial sequence
  Synthetic oligonucleotide
ggctgatggacgcaagcctgcctcg

SEQ ID NO: 725118 - DNA, 25 bp, Artificial sequence
  Synthetic oligonucleotide
cgcgcatctgacctggctgatggac

SEQ ID NO: 725119 - DNA, 25 bp, Artificial sequence
  Synthetic oligonucleotide
cgctcccgcgcatctgacctggctg

SEQ ID NO: 725120 - DNA, 25 bp, Artificial sequence
  Synthetic oligonucleotide
gatatccgctcccgcgcatctgacc

SEQ ID NO: 725121 - DNA, 25 bp, Artificial sequence
  Synthetic oligonucleotide
gctatgttccccaacatggctccgt

SEQ ID NO: 725122 - DNA, 25 bp, Artificial sequence
  Synthetic oligonucleotide
gcctctgcctggtaaacaatttccg

SEQ ID NO: 725123 - DNA, 25 bp, Artificial sequence
  Synthetic oligonucleotide
catcccgagtccatcctcaccgagc

SEQ ID NO: 725124 - DNA, 25 bp, Artificial sequence
  Synthetic oligonucleotide
taactgagatggatatcaagggagc

SEQ ID NO: 725125 - DNA, 25 bp, Artificial sequence
  Synthetic oligonucleotide
ggagggtaactgagatggatatcaa

SEQ ID NO: 725126 - DNA, 25 bp, Artificial sequence
  Synthetic oligonucleotide
tgcgtggggagggtaactgagatgg

SEQ ID NO: 725127 - DNA, 25 bp, Artificial sequence
  Synthetic oligonucleotide
gcggcgtgcgtggggagggtaactg

SEQ ID NO: 725128 - DNA, 25 bp, Artificial sequence
  Synthetic oligonucleotide
ccagcagggcggcgtgcgtggggag

SEQ ID NO: 725129 - DNA, 25 bp, Artificial sequence
  Synthetic oligonucleotide
cctccgccagcagggcggcgtgcgt

SEQ ID NO: 725130 - DNA, 25 bp, Artificial sequence
  Synthetic oligonucleotide
caacttcctccgccagcagggcggc

SEQ ID NO: 725131 - DNA, 25 bp, Artificial sequence
  Synthetic oligonucleotide
tgctggccaacttcctccgccagca

SEQ ID NO: 725132 - DNA, 25 bp, Artificial sequence
  Synthetic oligonucleotide
acgagttgctggccaacttcctccg

SEQ ID NO: 725133 - DNA, 25 bp, Artificial sequence
  Synthetic oligonucleotide
cagggccacgagttgctggccaact

SEQ ID NO: 725134 - DNA, 25 bp, Artificial sequence
  Synthetic oligonucleotide
accgagcagggccacgagttgctgg

SEQ ID NO: 725135 - DNA, 25 bp, Artificial sequence
  Synthetic oligonucleotide
ccaacatgccgacggatcgctcgac

SEQ ID NO: 725136 - DNA, 25 bp, Artificial sequence
  Synthetic oligonucleotide
gagtccatcctcaccgagcagggcc

SEQ ID NO: 725137 - DNA, 25 bp, Artificial sequence
  Synthetic oligonucleotide
aagggagccctcaatcgcatcgtca

SEQ ID NO: 725138 - DNA, 25 bp, Artificial sequence
  Synthetic oligonucleotide
cagttccatcccgagtccatcctca

SEQ ID NO: 725139 - DNA, 25 bp, Artificial sequence
  Synthetic oligonucleotide
gggcgtgcagttccatcccgagtcc

SEQ ID NO: 725140 - DNA, 25 bp, Artificial sequence
  Synthetic oligonucleotide
tgtcgagggcgtgcagttccatccc

SEQ ID NO: 725141 - DNA, 25 bp, Artificial sequence
  Synthetic oligonucleotide
cctgaatgtcgagggcgtgcagttc

SEQ ID NO: 725142 - DNA, 25 bp, Artificial sequence
  Synthetic oligonucleotide
aagaccctgaatgtcgagggcgtgc

SEQ ID NO: 725143 - DNA, 25 bp, Artificial sequence
  Synthetic oligonucleotide
cgccacaagaccctgaatgtcgagg

SEQ ID NO: 725144 - DNA, 25 bp, Artificial sequence
  Synthetic oligonucleotide
ggcgtacgccacaagaccctgaatg

SEQ ID NO: 725145 - DNA, 25 bp, Artificial sequence
  Synthetic oligonucleotide
atcatgggcgtacgccacaagaccc

SEQ ID NO: 725146 - DNA, 25 bp, Artificial sequence
  Synthetic oligonucleotide
acgagatcatgggcgtacgccacaa

SEQ ID NO: 725147 - DNA, 25 bp, Artificial sequence
  Synthetic oligonucleotide
cgctcgacgagatcatgggcgtacg

SEQ ID NO: 725148 - DNA, 25 bp, Artificial sequence
  Synthetic oligonucleotide
acggatcgctcgacgagatcatggg

SEQ ID NO: 725149 - DNA, 25 bp, Artificial sequence
  Synthetic oligonucleotide
gaggtcaaggtggtgcgtaacgacg

SEQ ID NO: 725150 - DNA, 25 bp, Artificial sequence
  Synthetic oligonucleotide
atcctcaccgagcagggccacgagt

SEQ ID NO: 725151 - DNA, 25 bp, Artificial sequence
  Synthetic oligonucleotide
atcatgaccgggcagtgcaccgacg

SEQ ID NO: 725152 - DNA, 25 bp, Artificial sequence
  Synthetic oligonucleotide
accggatcaggtttccagagagcgg

SEQ ID NO: 725153 - DNA, 25 bp, Artificial sequence
  Synthetic oligonucleotide
gagatcgtcggcgcggtggcggtga

SEQ ID NO: 725154 - DNA, 25 bp, Artificial sequence
  Synthetic oligonucleotide
atcgacgagatcgtcggcgcggtgg

SEQ ID NO: 725155 - DNA, 25 bp, Artificial sequence
  Synthetic oligonucleotide
gaaaccatcgacgagatcgtcggcg

SEQ ID NO: 725156 - DNA, 25 bp, Artificial sequence
  Synthetic oligonucleotide
aagagcgaaaccatcgacgagatcg

SEQ ID NO: 725157 - DNA, 25 bp, Artificial sequence
  Synthetic oligonucleotide
cggatgaagagcgaaaccatcgacg

SEQ ID NO: 725158 - DNA, 25 bp, Artificial sequence
  Synthetic oligonucleotide
ggcatgcggatgaagagcgaaacca

SEQ ID NO: 725159 - DNA, 25 bp, Artificial sequence
  Synthetic oligonucleotide
cctgatgggcatgcggatgaagagc

SEQ ID NO: 725160 - DNA, 25 bp, Artificial sequence
  Synthetic oligonucleotide
cgccttcctgatgggcatgcggatg

SEQ ID NO: 725161 - DNA, 25 bp, Artificial sequence
  Synthetic oligonucleotide
gatcggcgccttcctgatgggcatg

SEQ ID NO: 725162 - DNA, 25 bp, Artificial sequence
  Synthetic oligonucleotide
cgcgcagatcggcgccttcctgatg

SEQ ID NO: 725163 - DNA, 25 bp, Artificial sequence
  Synthetic oligonucleotide
caccgacgcgcagatcggcgccttc

SEQ ID NO: 725164 - DNA, 25 bp, Artificial sequence
  Synthetic oligonucleotide
agatggatatcaagggagccctcaa

SEQ ID NO: 725165 - DNA, 25 bp, Artificial sequence
  Synthetic oligonucleotide
accgggcagtgcaccgacgcgcaga

SEQ ID NO: 725166 - DNA, 25 bp, Artificial sequence
  Synthetic oligonucleotide
gatatcaagggagccctcaatcgca

SEQ ID NO: 725167 - DNA, 25 bp, Artificial sequence
  Synthetic oligonucleotide
cgccagatcatgaccgggcagtgca

SEQ ID NO: 725168 - DNA, 25 bp, Artificial sequence
  Synthetic oligonucleotide
gtcatgcgccagatcatgaccgggc

SEQ ID NO: 725169 - DNA, 25 bp, Artificial sequence
  Synthetic oligonucleotide
caggcggtcatgcgccagatcatga

SEQ ID NO: 725170 - DNA, 25 bp, Artificial sequence
  Synthetic oligonucleotide
gaaatgcaggcggtcatgcgccaga

SEQ ID NO: 725171 - DNA, 25 bp, Artificial sequence
  Synthetic oligonucleotide
caccgaggaaatgcaggcggtcatg

SEQ ID NO: 725172 - DNA, 25 bp, Artificial sequence
  Synthetic oligonucleotide
ctgaccaccgaggaaatgcaggcgg

SEQ ID NO: 725173 - DNA, 25 bp, Artificial sequence
  Synthetic oligonucleotide
ctcgacctgaccaccgaggaaatgc

SEQ ID NO: 725174 - DNA, 25 bp, Artificial sequence
  Synthetic oligonucleotide
aaccagctcgacctgaccaccgagg

SEQ ID NO: 725175 - DNA, 25 bp, Artificial sequence
  Synthetic oligonucleotide
atcgtcaaccagctcgacctgacca

SEQ ID NO: 725176 - DNA, 25 bp, Artificial sequence
  Synthetic oligonucleotide
aatcgcatcgtcaaccagctcgacc

SEQ ID NO: 725177 - DNA, 25 bp, Artificial sequence
  Synthetic oligonucleotide
gccctcaatcgcatcgtcaaccagc

SEQ ID NO: 725178 - DNA, 25 bp, Artificial sequence
  Synthetic oligonucleotide
ctggacccaacatgccgacggatcg

SEQ ID NO: 725179 - DNA, 25 bp, Artificial sequence
  Synthetic oligonucleotide
gcagtgcaccgacgcgcagatcggc

SEQ ID NO: 725180 - DNA, 25 bp, Artificial sequence
  Synthetic oligonucleotide
ccggcgtctcgctggccgttatcga

SEQ ID NO: 725181 - DNA, 25 bp, Artificial sequence
  Synthetic oligonucleotide
tcggccaggccttcggcggcgaagt

SEQ ID NO: 725182 - DNA, 25 bp, Artificial sequence
  Synthetic oligonucleotide
agagcatcggccaggccttcggcgg

SEQ ID NO: 725183 - DNA, 25 bp, Artificial sequence
  Synthetic oligonucleotide
gccatcagagcatcggccaggcctt

SEQ ID NO: 725184 - DNA, 25 bp, Artificial sequence
  Synthetic oligonucleotide
gccttggccatcagagcatcggcca

SEQ ID NO: 725185 - DNA, 25 bp, Artificial sequence
  Synthetic oligonucleotide
tgtctgccttggccatcagagcatc

SEQ ID NO: 725186 - DNA, 25 bp, Artificial sequence
  Synthetic oligonucleotide
tgctcggtgtctgccttggccatca

SEQ ID NO: 725187 - DNA, 25 bp, Artificial sequence
  Synthetic oligonucleotide
tgccgctgctcggtgtctgccttgg

SEQ ID NO: 725188 - DNA, 25 bp, Artificial sequence
  Synthetic oligonucleotide
gcaagctgccgctgctcggtgtctg

SEQ ID NO: 725189 - DNA, 25 bp, Artificial sequence
  Synthetic oligonucleotide
tcgccggcaagctgccgctgctcgg

SEQ ID NO: 725190 - DNA, 25 bp, Artificial sequence
  Synthetic oligonucleotide
agcgcttcgccggcaagctgccgct

SEQ ID NO: 725191 - DNA, 25 bp, Artificial sequence
  Synthetic oligonucleotide
ttatcgagcgcttcgccggcaagct

SEQ ID NO: 725192 - DNA, 25 bp, Artificial sequence
  Synthetic oligonucleotide
atgccgacggatcgctcgacgagat

SEQ ID NO: 725193 - DNA, 25 bp, Artificial sequence
  Synthetic oligonucleotide
tctcgctggccgttatcgagcgctt

SEQ ID NO: 725194 - DNA, 25 bp, Artificial sequence
  Synthetic oligonucleotide
cggcgaagtggtgcgggcgcggcag

SEQ ID NO: 725195 - DNA, 25 bp, Artificial sequence
  Synthetic oligonucleotide
aacgaggccggcgtctcgctggccg

SEQ ID NO: 725196 - DNA, 25 bp, Artificial sequence
  Synthetic oligonucleotide
cacccccaacgaggccggcgtctcg

SEQ ID NO: 725197 - DNA, 25 bp, Artificial sequence
  Synthetic oligonucleotide
tccctgcacccccaacgaggccggc

SEQ ID NO: 725198 - DNA, 25 bp, Artificial sequence
  Synthetic oligonucleotide
gagcgcatcgtcctttcccccggtc

SEQ ID NO: 725199 - DNA, 25 bp, Artificial sequence
  Synthetic oligonucleotide
cgcccgagcgcatcgtcctttcccc

SEQ ID NO: 725200 - DNA, 25 bp, Artificial sequence
  Synthetic oligonucleotide
gccctggcgcccgagcgcatcgtcc

SEQ ID NO: 725201 - DNA, 25 bp, Artificial sequence
  Synthetic oligonucleotide
atcgaggccctggcgcccgagcgca

SEQ ID NO: 725202 - DNA, 25 bp, Artificial sequence
  Synthetic oligonucleotide
aacagatcgaggccctggcgcccga

SEQ ID NO: 725203 - DNA, 25 bp, Artificial sequence
  Synthetic oligonucleotide
gcgtggaacagatcgaggccctggc

SEQ ID NO: 725204 - DNA, 25 bp, Artificial sequence
  Synthetic oligonucleotide
aactgagcgtggaacagatcgaggc

SEQ ID NO: 725205 - DNA, 25 bp, Artificial sequence
  Synthetic oligonucleotide
acgacgaactgagcgtggaacagat

SEQ ID NO: 725206 - DNA, 25 bp, Artificial sequence
  Synthetic oligonucleotide
cgcggtggcggtgatgcgcgaactg

SEQ ID NO: 725207 - DNA, 25 bp, Artificial sequence
  Synthetic oligonucleotide
tggccgttatcgagcgcttcgccgg

SEQ ID NO: 725208 - DNA, 25 bp, Artificial sequence
  Synthetic oligonucleotide
cgccggcctggccaatcccctgacg

SEQ ID NO: 725209 - DNA, 25 bp, Artificial sequence
  Synthetic oligonucleotide
tcaccgcctggacccaacatgccga

SEQ ID NO: 725210 - DNA, 25 bp, Artificial sequence
  Synthetic oligonucleotide
tggaggtcaccgcctggacccaaca

SEQ ID NO: 725211 - DNA, 25 bp, Artificial sequence
  Synthetic oligonucleotide
gagtgcctggaggtcaccgcctgga

SEQ ID NO: 725212 - DNA, 25 bp, Artificial sequence
  Synthetic oligonucleotide
ctgccggagtgcctggaggtcaccg

SEQ ID NO: 725213 - DNA, 25 bp, Artificial sequence
  Synthetic oligonucleotide
agagcctgccggagtgcctggaggt

SEQ ID NO: 725214 - DNA, 25 bp, Artificial sequence
  Synthetic oligonucleotide
agcgagagagcctgccggagtgcct

SEQ ID NO: 725215 - DNA, 25 bp, Artificial sequence
  Synthetic oligonucleotide
tggtgaagcgagagagcctgccgga

SEQ ID NO: 725216 - DNA, 25 bp, Artificial sequence
  Synthetic oligonucleotide
cgctggtggtgaagcgagagagcct

SEQ ID NO: 725217 - DNA, 25 bp, Artificial sequence
  Synthetic oligonucleotide
accactcgctggtggtgaagcgaga

SEQ ID NO: 725218 - DNA, 25 bp, Artificial sequence
  Synthetic oligonucleotide
gcgctaccactcgctggtggtgaag

SEQ ID NO: 725219 - DNA, 25 bp, Artificial sequence
  Synthetic oligonucleotide
gtgacgcgctaccactcgctggtgg

SEQ ID NO: 725220 - DNA, 25 bp, Artificial sequence
  Synthetic oligonucleotide
ctgacggtgacgcgctaccactcgc

SEQ ID NO: 725221 - DNA, 25 bp, Artificial sequence
  Synthetic oligonucleotide
aggccttcggcggcgaagtggtgcg

SEQ ID NO: 725222 - DNA, 25 bp, Artificial sequence
  Synthetic oligonucleotide
ctggccaatcccctgacggtgacgc

SEQ ID NO: 725223 - DNA, 25 bp, Artificial sequence
  Synthetic oligonucleotide
ttcggcggcgaagtggtgcgggcgc

SEQ ID NO: 725224 - DNA, 25 bp, Artificial sequence
  Synthetic oligonucleotide
gcgtgttcgccggcctggccaatcc

SEQ ID NO: 725225 - DNA, 25 bp, Artificial sequence
  Synthetic oligonucleotide
acctcggcgtgttcgccggcctggc

SEQ ID NO: 725226 - DNA, 25 bp, Artificial sequence
  Synthetic oligonucleotide
acaaggacctcggcgtgttcgccgg

SEQ ID NO: 725227 - DNA, 25 bp, Artificial sequence
  Synthetic oligonucleotide
tccaccacaaggacctcggcgtgtt

SEQ ID NO: 725228 - DNA, 25 bp, Artificial sequence
  Synthetic oligonucleotide
agcccgatccaccacaaggacctcg

SEQ ID NO: 725229 - DNA, 25 bp, Artificial sequence
  Synthetic oligonucleotide
aagaccagcccgatccaccacaagg

SEQ ID NO: 725230 - DNA, 25 bp, Artificial sequence
  Synthetic oligonucleotide
cacggcaagaccagcccgatccacc

SEQ ID NO: 725231 - DNA, 25 bp, Artificial sequence
  Synthetic oligonucleotide
gtgatgcacggcaagaccagcccga

SEQ ID NO: 725232 - DNA, 25 bp, Artificial sequence
  Synthetic oligonucleotide
cggcaggtgatgcacggcaagacca

SEQ ID NO: 725233 - DNA, 25 bp, Artificial sequence
  Synthetic oligonucleotide
cgggcgcggcaggtgatgcacggca

SEQ ID NO: 725234 - DNA, 25 bp, Artificial sequence
  Synthetic oligonucleotide
agtggtgcgggcgcggcaggtgatg

SEQ ID NO: 725235 - DNA, 25 bp, Artificial sequence
  Synthetic oligonucleotide
aaggtggtgcgtaacgacgaactga

SEQ ID NO: 725236 - DNA, 25 bp, Artificial sequence
  Synthetic oligonucleotide
aatcccctgacggtgacgcgctacc

SEQ ID NO: 725237 - DNA, 25 bp, Artificial sequence
  Synthetic oligonucleotide
tcaactacagcagcagccgccagcg

SEQ ID NO: 725238 - DNA, 25 bp, Artificial sequence
  Synthetic oligonucleotide
gccgtgggctggcgccggggaagat

SEQ ID NO: 725239 - DNA, 25 bp, Artificial sequence
  Synthetic oligonucleotide
cagagccaaccggtagcggtgaaca

SEQ ID NO: 725240 - DNA, 25 bp, Artificial sequence
  Synthetic oligonucleotide
cggttaccagagccaaccggtagcg

SEQ ID NO: 725241 - DNA, 25 bp, Artificial sequence
  Synthetic oligonucleotide
tccgggcaacggttaccagagccaa

SEQ ID NO: 725242 - DNA, 25 bp, Artificial sequence
  Synthetic oligonucleotide
cgacaatccgggcaacggttaccag

SEQ ID NO: 725243 - DNA, 25 bp, Artificial sequence
  Synthetic oligonucleotide
gtcaactacgacaatccgggcaacg

SEQ ID NO: 725244 - DNA, 25 bp, Artificial sequence
  Synthetic oligonucleotide
gccctggtcaactacgacaatccgg

SEQ ID NO: 725245 - DNA, 25 bp, Artificial sequence
  Synthetic oligonucleotide
accctggccctggtcaactacgaca

SEQ ID NO: 725246 - DNA, 25 bp, Artificial sequence
  Synthetic oligonucleotide
cgccacaccctggccctggtcaact

SEQ ID NO: 725247 - DNA, 25 bp, Artificial sequence
  Synthetic oligonucleotide
cgcgatcgccacaccctggccctgg

SEQ ID NO: 725248 - DNA, 25 bp, Artificial sequence
  Synthetic oligonucleotide
cgccagcgcgatcgccacaccctgg

SEQ ID NO: 725249 - DNA, 25 bp, Artificial sequence
  Synthetic oligonucleotide
gtagcggtgaacaatgaccgcgcgc

SEQ ID NO: 725250 - DNA, 25 bp, Artificial sequence
  Synthetic oligonucleotide
tacagcagcagccgccagcgcgatc

SEQ ID NO: 725251 - DNA, 25 bp, Artificial sequence
  Synthetic oligonucleotide
tgaacaatgaccgcgcgcagcgccg

SEQ ID NO: 725252 - DNA, 25 bp, Artificial sequence
  Synthetic oligonucleotide
gccacttcaactacagcagcagccg

SEQ ID NO: 725253 - DNA, 25 bp, Artificial sequence
  Synthetic oligonucleotide
acggcagccacttcaactacagcag

SEQ ID NO: 725254 - DNA, 25 bp, Artificial sequence
  Synthetic oligonucleotide
gcgacgacggcagccacttcaacta

SEQ ID NO: 725255 - DNA, 25 bp, Artificial sequence
  Synthetic oligonucleotide
tgcgtggcgacgacggcagccactt

SEQ ID NO: 725256 - DNA, 25 bp, Artificial sequence
  Synthetic oligonucleotide
aacaccgtgcgtggcgacgacggca

SEQ ID NO: 725257 - DNA, 25 bp, Artificial sequence
  Synthetic oligonucleotide
cgtcgaacaccgtgcgtggcgacga

SEQ ID NO: 725258 - DNA, 25 bp, Artificial sequence
  Synthetic oligonucleotide
ttctcgccgtcgaacaccgtgcgtg

SEQ ID NO: 725259 - DNA, 25 bp, Artificial sequence
  Synthetic oligonucleotide
ctacaccttctcgccgtcgaacacc

SEQ ID NO: 725260 - DNA, 25 bp, Artificial sequence
  Synthetic oligonucleotide
cgaggcctacaccttctcgccgtcg

SEQ ID NO: 725261 - DNA, 25 bp, Artificial sequence
  Synthetic oligonucleotide
ggaggacgaggcctacaccttctcg

SEQ ID NO: 725262 - DNA, 25 bp, Artificial sequence
  Synthetic oligonucleotide
catgccggaggacgaggcctacacc

SEQ ID NO: 725263 - DNA, 25 bp, Artificial sequence
  Synthetic oligonucleotide
atccgacatgccggaggacgaggcc

SEQ ID NO: 725264 - DNA, 25 bp, Artificial sequence
  Synthetic oligonucleotide
agcagccgccagcgcgatcgccaca

SEQ ID NO: 725265 - DNA, 25 bp, Artificial sequence
  Synthetic oligonucleotide
aggcgcagcggcgtggccagtgggc

SEQ ID NO: 725266 - DNA, 25 bp, Artificial sequence
  Synthetic oligonucleotide
tacgccagcagtgtggagaccgctc

SEQ ID NO: 725267 - DNA, 25 bp, Artificial sequence
  Synthetic oligonucleotide
cggcatggatggccgtgggctggcg

SEQ ID NO: 725268 - DNA, 25 bp, Artificial sequence
  Synthetic oligonucleotide
ccgcaccggcatggatggccgtggg

SEQ ID NO: 725269 - DNA, 25 bp, Artificial sequence
  Synthetic oligonucleotide
gaccttccgcaccggcatggatggc

SEQ ID NO: 725270 - DNA, 25 bp, Artificial sequence
  Synthetic oligonucleotide
gcggtgaccttccgcaccggcatgg

SEQ ID NO: 725271 - DNA, 25 bp, Artificial sequence
  Synthetic oligonucleotide
caggacgcggtgaccttccgcaccg

SEQ ID NO: 725272 - DNA, 25 bp, Artificial sequence
  Synthetic oligonucleotide
ctggagcaggacgcggtgaccttcc

SEQ ID NO: 725273 - DNA, 25 bp, Artificial sequence
  Synthetic oligonucleotide
aggagctggagcaggacgcggtgac

SEQ ID NO: 725274 - DNA, 25 bp, Artificial sequence
  Synthetic oligonucleotide
tgaccgaggagctggagcaggacgc

SEQ ID NO: 725275 - DNA, 25 bp, Artificial sequence
  Synthetic oligonucleotide
cgctgctgaccgaggagctggagca

SEQ ID NO: 725276 - DNA, 25 bp, Artificial sequence
  Synthetic oligonucleotide
agtgggcgctgctgaccgaggagct

SEQ ID NO: 725277 - DNA, 25 bp, Artificial sequence
  Synthetic oligonucleotide
ccaaccggtagcggtgaacaatgac

SEQ ID NO: 725278 - DNA, 25 bp, Artificial sequence
  Synthetic oligonucleotide
agcggcgtggccagtgggcgctgct

SEQ ID NO: 725279 - DNA, 25 bp, Artificial sequence
  Synthetic oligonucleotide
gcggaaatggtggcggtatccgaca

SEQ ID NO: 725280 - DNA, 25 bp, Artificial sequence
  Synthetic oligonucleotide
agggcgaggcgcagcggcgtggcca

SEQ ID NO: 725281 - DNA, 25 bp, Artificial sequence
  Synthetic oligonucleotide
ctccgagggcgaggcgcagcggcgt

SEQ ID NO: 725282 - DNA, 25 bp, Artificial sequence
  Synthetic oligonucleotide
ttgcacctccgagggcgaggcgcag

SEQ ID NO: 725283 - DNA, 25 bp, Artificial sequence
  Synthetic oligonucleotide
atcggttgcacctccgagggcgagg

SEQ ID NO: 725284 - DNA, 25 bp, Artificial sequence
  Synthetic oligonucleotide
accgcgatcggttgcacctccgagg

SEQ ID NO: 725285 - DNA, 25 bp, Artificial sequence
  Synthetic oligonucleotide
ggagatcaccgcgatcggttgcacc

SEQ ID NO: 725286 - DNA, 25 bp, Artificial sequence
  Synthetic oligonucleotide
cagttggagatcaccgcgatcggtt

SEQ ID NO: 725287 - DNA, 25 bp, Artificial sequence
  Synthetic oligonucleotide
atcagccagttggagatcaccgcga

SEQ ID NO: 725288 - DNA, 25 bp, Artificial sequence
  Synthetic oligonucleotide
tacggcatcagccagttggagatca

SEQ ID NO: 725289 - DNA, 25 bp, Artificial sequence
  Synthetic oligonucleotide
gcgccgctacggcatcagccagttg

SEQ ID NO: 725290 - DNA, 25 bp, Artificial sequence
  Synthetic oligonucleotide
gcgcgcagcgccgctacggcatcag

SEQ ID NO: 725291 - DNA, 25 bp, Artificial sequence
  Synthetic oligonucleotide
atgaccgcgcgcagcgccgctacgg

SEQ ID NO: 725292 - DNA, 25 bp, Artificial sequence
  Synthetic oligonucleotide
gtggccagtgggcgctgctgaccga

SEQ ID NO: 725293 - DNA, 25 bp, Artificial sequence
  Synthetic oligonucleotide
gcctggaccagcaacccggcctggc

SEQ ID NO: 725294 - DNA, 25 bp, Artificial sequence
  Synthetic oligonucleotide
cgcgagcatggtcgacaagtggtcg

SEQ ID NO: 725295 - DNA, 25 bp, Artificial sequence
  Synthetic oligonucleotide
gatcgacgcgagcatggtcgacaag

SEQ ID NO: 725296 - DNA, 25 bp, Artificial sequence
  Synthetic oligonucleotide
tcggcggatcgacgcgagcatggtc

SEQ ID NO: 725297 - DNA, 25 bp, Artificial sequence
  Synthetic oligonucleotide
ctcggtcggcggatcgacgcgagca

SEQ ID NO: 725298 - DNA, 25 bp, Artificial sequence
  Synthetic oligonucleotide
ttcggcctcggtcggcggatcgacg

SEQ ID NO: 725299 - DNA, 25 bp, Artificial sequence
  Synthetic oligonucleotide
aagcgcttcggcctcggtcggcgga

SEQ ID NO: 725300 - DNA, 25 bp, Artificial sequence
  Synthetic oligonucleotide
ttgcacaagcgcttcggcctcggtc

SEQ ID NO: 725301 - DNA, 25 bp, Artificial sequence
  Synthetic oligonucleotide
atcgtgttgcacaagcgcttcggcc

SEQ ID NO: 725302 - DNA, 25 bp, Artificial sequence
  Synthetic oligonucleotide
tacgacatcgtgttgcacaagcgct

SEQ ID NO: 725303 - DNA, 25 bp, Artificial sequence
  Synthetic oligonucleotide
cactggtacgacatcgtgttgcaca

SEQ ID NO: 725304 - DNA, 25 bp, Artificial sequence
  Synthetic oligonucleotide
gcctggcactggtacgacatcgtgt

SEQ ID NO: 725305 - DNA, 25 bp, Artificial sequence
  Synthetic oligonucleotide
ggcggtatccgacatgccggaggac

SEQ ID NO: 725306 - DNA, 25 bp, Artificial sequence
  Synthetic oligonucleotide
accagcaacccggcctggcactggt

SEQ ID NO: 725307 - DNA, 25 bp, Artificial sequence
  Synthetic oligonucleotide
tggtcgctgtaccgcatcgcccagt

SEQ ID NO: 725308 - DNA, 25 bp, Artificial sequence
  Synthetic oligonucleotide
aagtcggcctggaccagcaacccgg

SEQ ID NO: 725309 - DNA, 25 bp, Artificial sequence
  Synthetic oligonucleotide
tcgttcaagtcggcctggaccagca

SEQ ID NO: 725310 - DNA, 25 bp, Artificial sequence
  Synthetic oligonucleotide
gacggctcgttcaagtcggcctgga

SEQ ID NO: 725311 - DNA, 25 bp, Artificial sequence
  Synthetic oligonucleotide
acctgggacggctcgttcaagtcgg

SEQ ID NO: 725312 - DNA, 25 bp, Artificial sequence
  Synthetic oligonucleotide
agcggcacctgggacggctcgttca

SEQ ID NO: 725313 - DNA, 25 bp, Artificial sequence
  Synthetic oligonucleotide
agctacagcggcacctgggacggct

SEQ ID NO: 725314 - DNA, 25 bp, Artificial sequence
  Synthetic oligonucleotide
acccgtagctacagcggcacctggg

SEQ ID NO: 725315 - DNA, 25 bp, Artificial sequence
  Synthetic oligonucleotide
ccgcagacccgtagctacagcggca

SEQ ID NO: 725316 - DNA, 25 bp, Artificial sequence
  Synthetic oligonucleotide
tacgatccgcagacccgtagctaca

SEQ ID NO: 725317 - DNA, 25 bp, Artificial sequence
  Synthetic oligonucleotide
agcaactacgatccgcagacccgta

SEQ ID NO: 725318 - DNA, 25 bp, Artificial sequence
  Synthetic oligonucleotide
gtgccgagcaactacgatccgcaga

SEQ ID NO: 725319 - DNA, 25 bp, Artificial sequence
  Synthetic oligonucleotide
gtgcgggtgccgagcaactacgatc

SEQ ID NO: 725320 - DNA, 25 bp, Artificial sequence
  Synthetic oligonucleotide
aacccggcctggcactggtacgaca

SEQ ID NO: 725321 - DNA, 25 bp, Artificial sequence
  Synthetic oligonucleotide
tgtacctgcagagtcgcgccgaagc

SEQ ID NO: 725322 - DNA, 25 bp, Artificial sequence
  Synthetic oligonucleotide
ggctggcgccggggaagatcatcgc

SEQ ID NO: 725323 - DNA, 25 bp, Artificial sequence
  Synthetic oligonucleotide
tccggcgcggaaatggtggcggtat

SEQ ID NO: 725324 - DNA, 25 bp, Artificial sequence
  Synthetic oligonucleotide
tactggtccggcgcggaaatggtgg

SEQ ID NO: 725325 - DNA, 25 bp, Artificial sequence
  Synthetic oligonucleotide
atgtcctactggtccggcgcggaaa

SEQ ID NO: 725326 - DNA, 25 bp, Artificial sequence
  Synthetic oligonucleotide
cgcggcatgtcctactggtccggcg

SEQ ID NO: 725327 - DNA, 25 bp, Artificial sequence
  Synthetic oligonucleotide
atcttccgcggcatgtcctactggt

SEQ ID NO: 725328 - DNA, 25 bp, Artificial sequence
  Synthetic oligonucleotide
gcagcgatcttccgcggcatgtcct

SEQ ID NO: 725329 - DNA, 25 bp, Artificial sequence
  Synthetic oligonucleotide
acctggcagcgatcttccgcggcat

SEQ ID NO: 725330 - DNA, 25 bp, Artificial sequence
  Synthetic oligonucleotide
tgcgcgacctggcagcgatcttccg

SEQ ID NO: 725331 - DNA, 25 bp, Artificial sequence
  Synthetic oligonucleotide
ccgtgctgcgcgacctggcagcgat

SEQ ID NO: 725332 - DNA, 25 bp, Artificial sequence
  Synthetic oligonucleotide
gcctggaccgtgctgcgcgacctgg

SEQ ID NO: 725333 - DNA, 25 bp, Artificial sequence
  Synthetic oligonucleotide
gccgaagcctggaccgtgctgcgcg

SEQ ID NO: 725334 - DNA, 25 bp, Artificial sequence
  Synthetic oligonucleotide
catggtcgacaagtggtcgctgtac

SEQ ID NO: 725335 - DNA, 25 bp, Artificial sequence
  Synthetic oligonucleotide
ctgcagagtcgcgccgaagcctgga

SEQ ID NO: 725336 - DNA, 25 bp, Artificial sequence
  Synthetic oligonucleotide
gacaagtggtcgctgtaccgcatcg

SEQ ID NO: 725337 - DNA, 25 bp, Artificial sequence
  Synthetic oligonucleotide
gcaacctgtacctgcagagtcgcgc

SEQ ID NO: 725338 - DNA, 25 bp, Artificial sequence
  Synthetic oligonucleotide
cagctgcaacctgtacctgcagagt

SEQ ID NO: 725339 - DNA, 25 bp, Artificial sequence
  Synthetic oligonucleotide
gcgcttcagctgcaacctgtacctg

SEQ ID NO: 725340 - DNA, 25 bp, Artificial sequence
  Synthetic oligonucleotide
gagccgcgcttcagctgcaacctgt

SEQ ID NO: 725341 - DNA, 25 bp, Artificial sequence
  Synthetic oligonucleotide
ggccaggagccgcgcttcagctgca

SEQ ID NO: 725342 - DNA, 25 bp, Artificial sequence
  Synthetic oligonucleotide
aagggcggccaggagccgcgcttca

SEQ ID NO: 725343 - DNA, 25 bp, Artificial sequence
  Synthetic oligonucleotide
gacggcaagggcggccaggagccgc

SEQ ID NO: 725344 - DNA, 25 bp, Artificial sequence
  Synthetic oligonucleotide
gtgcccgacggcaagggcggccagg

SEQ ID NO: 725345 - DNA, 25 bp, Artificial sequence
  Synthetic oligonucleotide
cagtcggtgcccgacggcaagggcg

SEQ ID NO: 725346 - DNA, 25 bp, Artificial sequence
  Synthetic oligonucleotide
tgcgaccagtcggtgcccgacggca

SEQ ID NO: 725347 - DNA, 25 bp, Artificial sequence
  Synthetic oligonucleotide
tgtaccgcatcgcccagtactgcga

SEQ ID NO: 725348 - DNA, 25 bp, Artificial sequence
  Synthetic oligonucleotide
aatggtggcggtatccgacatgccg

SEQ ID NO: 725349 - DNA, 25 bp, Artificial sequence
  Synthetic oligonucleotide
agtcgcgccgaagcctggaccgtgc

SEQ ID NO: 725350 - DNA, 25 bp, Artificial sequence
  Synthetic oligonucleotide
gcgccgccgcagaacgtgcggatca

SEQ ID NO: 725351 - DNA, 25 bp, Artificial sequence
  Synthetic oligonucleotide
tggatggccgtgggctggcgccggg

SEQ ID NO: 725352 - DNA, 25 bp, Artificial sequence
  Synthetic oligonucleotide
cctgggatgccgcgccgaacgcggt

SEQ ID NO: 725353 - DNA, 25 bp, Artificial sequence
  Synthetic oligonucleotide
tcggcctcctgggatgccgcgccga

SEQ ID NO: 725354 - DNA, 25 bp, Artificial sequence
  Synthetic oligonucleotide
agcctgtcggcctcctgggatgccg

SEQ ID NO: 725355 - DNA, 25 bp, Artificial sequence
  Synthetic oligonucleotide
gtgaccagcctgtcggcctcctggg

SEQ ID NO: 725356 - DNA, 25 bp, Artificial sequence
  Synthetic oligonucleotide
ttggcggtgaccagcctgtcggcct

SEQ ID NO: 725357 - DNA, 25 bp, Artificial sequence
  Synthetic oligonucleotide
ccaggggttggcggtgaccagcctg

SEQ ID NO: 725358 - DNA, 25 bp, Artificial sequence
  Synthetic oligonucleotide
gtcgaccaggggttggcggtgacca

SEQ ID NO: 725359 - DNA, 25 bp, Artificial sequence
  Synthetic oligonucleotide
tcaccaaggtcgaccaggggttggc

SEQ ID NO: 725360 - DNA, 25 bp, Artificial sequence
  Synthetic oligonucleotide
caaggctttcaccaaggtcgaccag

SEQ ID NO: 725361 - DNA, 25 bp, Artificial sequence
  Synthetic oligonucleotide
gcggatcaaggctttcaccaaggtc

SEQ ID NO: 725362 - DNA, 25 bp, Artificial sequence
  Synthetic oligonucleotide
cgccgaacgcggtggcctacgaggc

SEQ ID NO: 725363 - DNA, 25 bp, Artificial sequence
  Synthetic oligonucleotide
gccgcagaacgtgcggatcaaggct

SEQ ID NO: 725364 - DNA, 25 bp, Artificial sequence
  Synthetic oligonucleotide
aacgcggtggcctacgaggccgaat

SEQ ID NO: 725365 - DNA, 25 bp, Artificial sequence
  Synthetic oligonucleotide
gtgcaggcgccgccgcagaacgtgc

SEQ ID NO: 725366 - DNA, 25 bp, Artificial sequence
  Synthetic oligonucleotide
ccgggcgtgcaggcgccgccgcaga

SEQ ID NO: 725367 - DNA, 25 bp, Artificial sequence
  Synthetic oligonucleotide
attccgccgggcgtgcaggcgccgc

SEQ ID NO: 725368 - DNA, 25 bp, Artificial sequence
  Synthetic oligonucleotide
accagcattccgccgggcgtgcagg

SEQ ID NO: 725369 - DNA, 25 bp, Artificial sequence
  Synthetic oligonucleotide
ccggtcaccagcattccgccgggcg

SEQ ID NO: 725370 - DNA, 25 bp, Artificial sequence
  Synthetic oligonucleotide
ctgccgccggtcaccagcattccgc

SEQ ID NO: 725371 - DNA, 25 bp, Artificial sequence
  Synthetic oligonucleotide
atcgagctgccgccggtcaccagca

SEQ ID NO: 725372 - DNA, 25 bp, Artificial sequence
  Synthetic oligonucleotide
tgcgcgcatcgagctgccgccggtc

SEQ ID NO: 725373 - DNA, 25 bp, Artificial sequence
  Synthetic oligonucleotide
aacggtgcgcgcatcgagctgccgc

SEQ ID NO: 725374 - DNA, 25 bp, Artificial sequence
  Synthetic oligonucleotide
atcgacaacggtgcgcgcatcgagc

SEQ ID NO: 725375 - DNA, 25 bp, Artificial sequence
  Synthetic oligonucleotide
gacgccatcgacaacggtgcgcgca

SEQ ID NO: 725376 - DNA, 25 bp, Artificial sequence
  Synthetic oligonucleotide
aagttcgacgccatcgacaacggtg

SEQ ID NO: 725377 - DNA, 25 bp, Artificial sequence
  Synthetic oligonucleotide
gaacgtgcggatcaaggctttcacc

SEQ ID NO: 725378 - DNA, 25 bp, Artificial sequence
  Synthetic oligonucleotide
cggtttcgacgtgccgggcatctat

SEQ ID NO: 725379 - DNA, 25 bp, Artificial sequence
  Synthetic oligonucleotide
agcggccaagtttatgcggttgtcc

SEQ ID NO: 725380 - DNA, 25 bp, Artificial sequence
  Synthetic oligonucleotide
gtcggctcggtctacgccagcagtg

SEQ ID NO: 725381 - DNA, 25 bp, Artificial sequence
  Synthetic oligonucleotide
atggaggtcggctcggtctacgcca

SEQ ID NO: 725382 - DNA, 25 bp, Artificial sequence
  Synthetic oligonucleotide
acgtgatggaggtcggctcggtcta

SEQ ID NO: 725383 - DNA, 25 bp, Artificial sequence
  Synthetic oligonucleotide
ccttgaacgtgatggaggtcggctc

SEQ ID NO: 725384 - DNA, 25 bp, Artificial sequence
  Synthetic oligonucleotide
tacgcgccttgaacgtgatggaggt

SEQ ID NO: 725385 - DNA, 25 bp, Artificial sequence
  Synthetic oligonucleotide
gcgggtacgcgccttgaacgtgatg

SEQ ID NO: 725386 - DNA, 25 bp, Artificial sequence
  Synthetic oligonucleotide
tctggtgcgggtacgcgccttgaac

SEQ ID NO: 725387 - DNA, 25 bp, Artificial sequence
  Synthetic oligonucleotide
tcgctatctggtgcgggtacgcgcc

SEQ ID NO: 725388 - DNA, 25 bp, Artificial sequence
  Synthetic oligonucleotide
tgccggtcgctatctggtgcgggta

SEQ ID NO: 725389 - DNA, 25 bp, Artificial sequence
  Synthetic oligonucleotide
catctatgccggtcgctatctggtg

SEQ ID NO: 725390 - DNA, 25 bp, Artificial sequence
  Synthetic oligonucleotide
atgccgcgccgaacgcggtggccta

SEQ ID NO: 725391 - DNA, 25 bp, Artificial sequence
  Synthetic oligonucleotide
gacgtgccgggcatctatgccggtc

SEQ ID NO: 725392 - DNA, 25 bp, Artificial sequence
  Synthetic oligonucleotide
gcaacacaacgcgagcaagttcgac

SEQ ID NO: 725393 - DNA, 25 bp, Artificial sequence
  Synthetic oligonucleotide
ggcgctcggtttcgacgtgccgggc

SEQ ID NO: 725394 - DNA, 25 bp, Artificial sequence
  Synthetic oligonucleotide
aacctcggcgctcggtttcgacgtg

SEQ ID NO: 725395 - DNA, 25 bp, Artificial sequence
  Synthetic oligonucleotide
ccgcgaacctcggcgctcggtttcg

SEQ ID NO: 725396 - DNA, 25 bp, Artificial sequence
  Synthetic oligonucleotide
cgggtgccgcgaacctcggcgctcg

SEQ ID NO: 725397 - DNA, 25 bp, Artificial sequence
  Synthetic oligonucleotide
tgggtgcgggtgccgcgaacctcgg

SEQ ID NO: 725398 - DNA, 25 bp, Artificial sequence
  Synthetic oligonucleotide
gcaactgggtgcgggtgccgcgaac

SEQ ID NO: 725399 - DNA, 25 bp, Artificial sequence
  Synthetic oligonucleotide
actcgggcaactgggtgcgggtgcc

SEQ ID NO: 725400 - DNA, 25 bp, Artificial sequence
  Synthetic oligonucleotide
caaggactcgggcaactgggtgcgg

SEQ ID NO: 725401 - DNA, 25 bp, Artificial sequence
  Synthetic oligonucleotide
atggcgcaaggactcgggcaactgg

SEQ ID NO: 725402 - DNA, 25 bp, Artificial sequence
  Synthetic oligonucleotide
ggccgaatggcgcaaggactcgggc

SEQ ID NO: 725403 - DNA, 25 bp, Artificial sequence
  Synthetic oligonucleotide
ctacgaggccgaatggcgcaaggac

SEQ ID NO: 725404 - DNA, 25 bp, Artificial sequence
  Synthetic oligonucleotide
ggtggcctacgaggccgaatggcgc

SEQ ID NO: 725405 - DNA, 25 bp, Artificial sequence
  Synthetic oligonucleotide
gccgggcatctatgccggtcgctat

SEQ ID NO: 725406 - DNA, 25 bp, Artificial sequence
  Synthetic oligonucleotide
gatggccgcgcgctgaccctcgacc

SEQ ID NO: 725407 - DNA, 25 bp, Artificial sequence
  Synthetic oligonucleotide
ggccgaggcgcgcagcgtccagtcg

SEQ ID NO: 725408 - DNA, 25 bp, Artificial sequence
  Synthetic oligonucleotide
acggcaaggccgaggcgcgcagcgt

SEQ ID NO: 725409 - DNA, 25 bp, Artificial sequence
  Synthetic oligonucleotide
tgccgaacggcaaggccgaggcgcg

SEQ ID NO: 725410 - DNA, 25 bp, Artificial sequence
  Synthetic oligonucleotide
tcaacctgccgaacggcaaggccga

SEQ ID NO: 725411 - DNA, 25 bp, Artificial sequence
  Synthetic oligonucleotide
tgctggtcaacctgccgaacggcaa

SEQ ID NO: 725412 - DNA, 25 bp, Artificial sequence
  Synthetic oligonucleotide
atcgcctgctggtcaacctgccgaa

SEQ ID NO: 725413 - DNA, 25 bp, Artificial sequence
  Synthetic oligonucleotide
cccggcgatcgcctgctggtcaacc

SEQ ID NO: 725414 - DNA, 25 bp, Artificial sequence
  Synthetic oligonucleotide
gcccgacccggcgatcgcctgctgg

SEQ ID NO: 725415 - DNA, 25 bp, Artificial sequence
  Synthetic oligonucleotide
gtcgaggcccgacccggcgatcgcc

SEQ ID NO: 725416 - DNA, 25 bp, Artificial sequence
  Synthetic oligonucleotide
cgcgacgtcgaggcccgacccggcg

SEQ ID NO: 725417 - DNA, 25 bp, Artificial sequence
  Synthetic oligonucleotide
cctcgaccgcgacgtcgaggcccga

SEQ ID NO: 725418 - DNA, 25 bp, Artificial sequence
  Synthetic oligonucleotide
gcgagcaagttcgacgccatcgaca

SEQ ID NO: 725419 - DNA, 25 bp, Artificial sequence
  Synthetic oligonucleotide
cgcgcgctgaccctcgaccgcgacg

SEQ ID NO: 725420 - DNA, 25 bp, Artificial sequence
  Synthetic oligonucleotide
ccagtcggtggtaggccgcgtgctg

SEQ ID NO: 725421 - DNA, 25 bp, Artificial sequence
  Synthetic oligonucleotide
gcggtggatggccgcgcgctgaccc

SEQ ID NO: 725422 - DNA, 25 bp, Artificial sequence
  Synthetic oligonucleotide
ctgagcgcggtggatggccgcgcgc

SEQ ID NO: 725423 - DNA, 25 bp, Artificial sequence
  Synthetic oligonucleotide
ggacgcctgagcgcggtggatggcc

SEQ ID NO: 725424 - DNA, 25 bp, Artificial sequence
  Synthetic oligonucleotide
atcggcggacgcctgagcgcggtgg

SEQ ID NO: 725425 - DNA, 25 bp, Artificial sequence
  Synthetic oligonucleotide
aagcagatcggcggacgcctgagcg

SEQ ID NO: 725426 - DNA, 25 bp, Artificial sequence
  Synthetic oligonucleotide
tccggcaagcagatcggcggacgcc

SEQ ID NO: 725427 - DNA, 25 bp, Artificial sequence
  Synthetic oligonucleotide
gtcaagtccggcaagcagatcggcg

SEQ ID NO: 725428 - DNA, 25 bp, Artificial sequence
  Synthetic oligonucleotide
gacccggtcaagtccggcaagcaga

SEQ ID NO: 725429 - DNA, 25 bp, Artificial sequence
  Synthetic oligonucleotide
gtagccgacccggtcaagtccggca

SEQ ID NO: 725430 - DNA, 25 bp, Artificial sequence
  Synthetic oligonucleotide
atcatcgccgtagccgacccggtca

SEQ ID NO: 725431 - DNA, 25 bp, Artificial sequence
  Synthetic oligonucleotide
ggaagatcatcgccgtagccgaccc

SEQ ID NO: 725432 - DNA, 25 bp, Artificial sequence
  Synthetic oligonucleotide
cgccggggaagatcatcgccgtagc

SEQ ID NO: 725433 - DNA, 25 bp, Artificial sequence
  Synthetic oligonucleotide
gctgaccctcgaccgcgacgtcgag

SEQ ID NO: 725434 - DNA, 25 bp, Artificial sequence
  Synthetic oligonucleotide
ctgcagagcaacagcctgaccaccc

SEQ ID NO: 725435 - DNA, 25 bp, Artificial sequence
  Synthetic oligonucleotide
gaagcgcgcggccggcgggtgcggg

SEQ ID NO: 725436 - DNA, 25 bp, Artificial sequence
  Synthetic oligonucleotide
cgcgctgcaacacaacgcgagcaag

SEQ ID NO: 725437 - DNA, 25 bp, Artificial sequence
  Synthetic oligonucleotide
gatcaccgcgctgcaacacaacgcg

SEQ ID NO: 725438 - DNA, 25 bp, Artificial sequence
  Synthetic oligonucleotide
tttcgagatcaccgcgctgcaacac

SEQ ID NO: 725439 - DNA, 25 bp, Artificial sequence
  Synthetic oligonucleotide
aatcttttcgagatcaccgcgctgc

SEQ ID NO: 725440 - DNA, 25 bp, Artificial sequence
  Synthetic oligonucleotide
ggaggacaatcttttcgagatcacc

SEQ ID NO: 725441 - DNA, 25 bp, Artificial sequence
  Synthetic oligonucleotide
ccggccggaggacaatcttttcgag

SEQ ID NO: 725442 - DNA, 25 bp, Artificial sequence
  Synthetic oligonucleotide
agcatcacccggccggaggacaatc

SEQ ID NO: 725443 - DNA, 25 bp, Artificial sequence
  Synthetic oligonucleotide
atcatgagcatcacccggccggagg

SEQ ID NO: 725444 - DNA, 25 bp, Artificial sequence
  Synthetic oligonucleotide
ttccgcatcatgagcatcacccggc

SEQ ID NO: 725445 - DNA, 25 bp, Artificial sequence
  Synthetic oligonucleotide
cagcgcttccgcatcatgagcatca

SEQ ID NO: 725446 - DNA, 25 bp, Artificial sequence
  Synthetic oligonucleotide
accacccagcgcttccgcatcatga

SEQ ID NO: 725447 - DNA, 25 bp, Artificial sequence
  Synthetic oligonucleotide
ggcgcgcagcgtccagtcggtggta

SEQ ID NO: 725448 - DNA, 25 bp, Artificial sequence
  Synthetic oligonucleotide
gagcaacagcctgaccacccagcgc

SEQ ID NO: 725449 - DNA, 25 bp, Artificial sequence
  Synthetic oligonucleotide
cagcgtccagtcggtggtaggccgc

SEQ ID NO: 725450 - DNA, 25 bp, Artificial sequence
  Synthetic oligonucleotide
tgggcgctgcagagcaacagcctga

SEQ ID NO: 725451 - DNA, 25 bp, Artificial sequence
  Synthetic oligonucleotide
gggcagtgggcgctgcagagcaaca

SEQ ID NO: 725452 - DNA, 25 bp, Artificial sequence
  Synthetic oligonucleotide
gccccaggggcagtgggcgctgcag

SEQ ID NO: 725453 - DNA, 25 bp, Artificial sequence
  Synthetic oligonucleotide
gcctcggccccaggggcagtgggcg

SEQ ID NO: 725454 - DNA, 25 bp, Artificial sequence
  Synthetic oligonucleotide
gagacgcctcggccccaggggcagt

SEQ ID NO: 725455 - DNA, 25 bp, Artificial sequence
  Synthetic oligonucleotide
tattcggagacgcctcggccccagg

SEQ ID NO: 725456 - DNA, 25 bp, Artificial sequence
  Synthetic oligonucleotide
cgccgcctattcggagacgcctcgg

SEQ ID NO: 725457 - DNA, 25 bp, Artificial sequence
  Synthetic oligonucleotide
ccgtgaccgccgcctattcggagac

SEQ ID NO: 725458 - DNA, 25 bp, Artificial sequence
  Synthetic oligonucleotide
gtgctgaccgtgaccgccgcctatt

SEQ ID NO: 725459 - DNA, 25 bp, Artificial sequence
  Synthetic oligonucleotide
aggccgcgtgctgaccgtgaccgcc

SEQ ID NO: 725460 - DNA, 25 bp, Artificial sequence
  Synthetic oligonucleotide
gtggtaggccgcgtgctgaccgtga

SEQ ID NO: 725461 - DNA, 25 bp, Artificial sequence
  Synthetic oligonucleotide
acaacgcgagcaagttcgacgccat

SEQ ID NO: 725462 - DNA, 25 bp, Artificial sequence
  Synthetic oligonucleotide
agcctgaccacccagcgcttccgca

SEQ ID NO: 725463 - DNA, 25 bp, Artificial sequence
  Synthetic oligonucleotide
cagatgctcagtccccaacccaagg

SEQ ID NO: 725464 - DNA, 25 bp, Artificial sequence
  Synthetic oligonucleotide
cggcgggtgcgggtgccgagcaact

SEQ ID NO: 725465 - DNA, 25 bp, Artificial sequence
  Synthetic oligonucleotide
acaccatcgcccagggccatccggt

SEQ ID NO: 725466 - DNA, 25 bp, Artificial sequence
  Synthetic oligonucleotide
cggtcaacaccatcgcccagggcca

SEQ ID NO: 725467 - DNA, 25 bp, Artificial sequence
  Synthetic oligonucleotide
gcggcccggtcaacaccatcgccca

SEQ ID NO: 725468 - DNA, 25 bp, Artificial sequence
  Synthetic oligonucleotide
ccttcggcggcccggtcaacaccat

SEQ ID NO: 725469 - DNA, 25 bp, Artificial sequence
  Synthetic oligonucleotide
agctatgccttcggcggcccggtca

SEQ ID NO: 725470 - DNA, 25 bp, Artificial sequence
  Synthetic oligonucleotide
gcccccagctatgccttcggcggcc

SEQ ID NO: 725471 - DNA, 25 bp, Artificial sequence
  Synthetic oligonucleotide
gagaacgcccccagctatgccttcg

SEQ ID NO: 725472 - DNA, 25 bp, Artificial sequence
  Synthetic oligonucleotide
gcccccgagaacgcccccagctatg

SEQ ID NO: 725473 - DNA, 25 bp, Artificial sequence
  Synthetic oligonucleotide
ctgaagggccgcgaggcccccgaga

SEQ ID NO: 725474 - DNA, 25 bp, Artificial sequence
  Synthetic oligonucleotide
caagggcctgaagggccgcgaggcc

SEQ ID NO: 725475 - DNA, 25 bp, Artificial sequence
  Synthetic oligonucleotide
agggccatccggtcggcgtgctcta

SEQ ID NO: 725476 - DNA, 25 bp, Artificial sequence
  Synthetic oligonucleotide
ctcagtccccaacccaagggcctga

SEQ ID NO: 725477 - DNA, 25 bp, Artificial sequence
  Synthetic oligonucleotide
atccggtcggcgtgctctacggcaa

SEQ ID NO: 725478 - DNA, 25 bp, Artificial sequence
  Synthetic oligonucleotide
gtcatgcagatgctcagtccccaac

SEQ ID NO: 725479 - DNA, 25 bp, Artificial sequence
  Synthetic oligonucleotide
gcggcgtcatgcagatgctcagtcc

SEQ ID NO: 725480 - DNA, 25 bp, Artificial sequence
  Synthetic oligonucleotide
ttggcgggcggcgtcatgcagatgc

SEQ ID NO: 725481 - DNA, 25 bp, Artificial sequence
  Synthetic oligonucleotide
agcatgttggcgggcggcgtcatgc

SEQ ID NO: 725482 - DNA, 25 bp, Artificial sequence
  Synthetic oligonucleotide
ggagtcagcatgttggcgggcggcg

SEQ ID NO: 725483 - DNA, 25 bp, Artificial sequence
  Synthetic oligonucleotide
accgctggagtcagcatgttggcgg

SEQ ID NO: 725484 - DNA, 25 bp, Artificial sequence
  Synthetic oligonucleotide
ctggtaaccgctggagtcagcatgt

SEQ ID NO: 725485 - DNA, 25 bp, Artificial sequence
  Synthetic oligonucleotide
tcgttcctggtaaccgctggagtca

SEQ ID NO: 725486 - DNA, 25 bp, Artificial sequence
  Synthetic oligonucleotide
accagttcgttcctggtaaccgctg

SEQ ID NO: 725487 - DNA, 25 bp, Artificial sequence
  Synthetic oligonucleotide
ctccggtggaaccagttcgttcctg

SEQ ID NO: 725488 - DNA, 25 bp, Artificial sequence
  Synthetic oligonucleotide
cgacgttcttctccggtggaaccag

SEQ ID NO: 725489 - DNA, 25 bp, Artificial sequence
  Synthetic oligonucleotide
ggattcacgacgttcttctccggtg

SEQ ID NO: 725490 - DNA, 25 bp, Artificial sequence
  Synthetic oligonucleotide
caacccaagggcctgaagggccgcg

SEQ ID NO: 725491 - DNA, 25 bp, Artificial sequence
  Synthetic oligonucleotide
ctgtagccggcaacgccgtaacagg

SEQ ID NO: 725492 - DNA, 25 bp, Artificial sequence
  Synthetic oligonucleotide
ccacaagggtggcagcaagaagccg

SEQ ID NO: 725493 - DNA, 25 bp, Artificial sequence
  Synthetic oligonucleotide
cacgggccacaagggtggcagcaag

SEQ ID NO: 725494 - DNA, 25 bp, Artificial sequence
  Synthetic oligonucleotide
accatcacgggccacaagggtggca

SEQ ID NO: 725495 - DNA, 25 bp, Artificial sequence
  Synthetic oligonucleotide
gaacaagaccatcacgggccacaag

SEQ ID NO: 725496 - DNA, 25 bp, Artificial sequence
  Synthetic oligonucleotide
cgtcatgaacaagaccatcacgggc

SEQ ID NO: 725497 - DNA, 25 bp, Artificial sequence
  Synthetic oligonucleotide
aaggaacgtcatgaacaagaccatc

SEQ ID NO: 725498 - DNA, 25 bp, Artificial sequence
  Synthetic oligonucleotide
tgcctgaaggaacgtcatgaacaag

SEQ ID NO: 725499 - DNA, 25 bp, Artificial sequence
  Synthetic oligonucleotide
tttttttgcctgaaggaacgtcatg

SEQ ID NO: 725500 - DNA, 25 bp, Artificial sequence
  Synthetic oligonucleotide
ccatgcgcgggcgtttttttgcctg

SEQ ID NO: 725501 - DNA, 25 bp, Artificial sequence
  Synthetic oligonucleotide
aggcccgccatgcgcgggcgttttt

SEQ ID NO: 725502 - DNA, 25 bp, Artificial sequence
  Synthetic oligonucleotide
cgtaacaggcccgccatgcgcgggc

SEQ ID NO: 725503 - DNA, 25 bp, Artificial sequence
  Synthetic oligonucleotide
tcgcccagggccatccggtcggcgt

SEQ ID NO: 725504 - DNA, 25 bp, Artificial sequence
  Synthetic oligonucleotide
gccggcaacgccgtaacaggcccgc

SEQ ID NO: 725505 - DNA, 25 bp, Artificial sequence
  Synthetic oligonucleotide
gccttgattgtcgtgggtggattca

SEQ ID NO: 725506 - DNA, 25 bp, Artificial sequence
  Synthetic oligonucleotide
gaccggctgtagccggcaacgccgt

SEQ ID NO: 725507 - DNA, 25 bp, Artificial sequence
  Synthetic oligonucleotide
gccgaggaccggctgtagccggcaa

SEQ ID NO: 725508 - DNA, 25 bp, Artificial sequence
  Synthetic oligonucleotide
atctatgccgaggaccggctgtagc

SEQ ID NO: 725509 - DNA, 25 bp, Artificial sequence
  Synthetic oligonucleotide
gccggcatctatgccgaggaccggc

SEQ ID NO: 725510 - DNA, 25 bp, Artificial sequence
  Synthetic oligonucleotide
atcagcgccggcatctatgccgagg

SEQ ID NO: 725511 - DNA, 25 bp, Artificial sequence
  Synthetic oligonucleotide
gcggtgatcagcgccggcatctatg

SEQ ID NO: 725512 - DNA, 25 bp, Artificial sequence
  Synthetic oligonucleotide
ggcggcgcggtgatcagcgccggca

SEQ ID NO: 725513 - DNA, 25 bp, Artificial sequence
  Synthetic oligonucleotide
cgcatcggcggcgcggtgatcagcg

SEQ ID NO: 725514 - DNA, 25 bp, Artificial sequence
  Synthetic oligonucleotide
aagcgccgcatcggcggcgcggtga

SEQ ID NO: 725515 - DNA, 25 bp, Artificial sequence
  Synthetic oligonucleotide
tacggcaagcgccgcatcggcggcg

SEQ ID NO: 725516 - DNA, 25 bp, Artificial sequence
  Synthetic oligonucleotide
tgctctacggcaagcgccgcatcgg

SEQ ID NO: 725517 - DNA, 25 bp, Artificial sequence
  Synthetic oligonucleotide
tcggcgtgctctacggcaagcgccg

SEQ ID NO: 725518 - DNA, 25 bp, Artificial sequence
  Synthetic oligonucleotide
aacgccgtaacaggcccgccatgcg

SEQ ID NO: 725519 - DNA, 25 bp, Artificial sequence
  Synthetic oligonucleotide
gcatgcacggccgattgttggaaag

SEQ ID NO: 725520 - DNA, 25 bp, Artificial sequence
  Synthetic oligonucleotide
ttcgagacgttcatgcgcgaggcgg

SEQ ID NO: 725521 - DNA, 25 bp, Artificial sequence
  Synthetic oligonucleotide
gagggattcgagacgttcatgcgcg

SEQ ID NO: 725522 - DNA, 25 bp, Artificial sequence
  Synthetic oligonucleotide
accatggagggattcgagacgttca

SEQ ID NO: 725523 - DNA, 25 bp, Artificial sequence
  Synthetic oligonucleotide
aagcacaccatggagggattcgaga

SEQ ID NO: 725524 - DNA, 25 bp, Artificial sequence
  Synthetic oligonucleotide
gccttgaagcacaccatggagggat

SEQ ID NO: 725525 - DNA, 25 bp, Artificial sequence
  Synthetic oligonucleotide
atgagtgccttgaagcacaccatgg

SEQ ID NO: 725526 - DNA, 25 bp, Artificial sequence
  Synthetic oligonucleotide
gaggcgatgagtgccttgaagcaca

SEQ ID NO: 725527 - DNA, 25 bp, Artificial sequence
  Synthetic oligonucleotide
tacgcgaggcgatgagtgccttgaa

SEQ ID NO: 725528 - DNA, 25 bp, Artificial sequence
  Synthetic oligonucleotide
cacggtacgcgaggcgatgagtgcc

SEQ ID NO: 725529 - DNA, 25 bp, Artificial sequence
  Synthetic oligonucleotide
agcggcacggtacgcgaggcgatga

SEQ ID NO: 725530 - DNA, 25 bp, Artificial sequence
  Synthetic oligonucleotide
ttggaaagcggcacggtacgcgagg

SEQ ID NO: 725531 - DNA, 25 bp, Artificial sequence
  Synthetic oligonucleotide
gtgggtggattcacgacgttcttct

SEQ ID NO: 725532 - DNA, 25 bp, Artificial sequence
  Synthetic oligonucleotide
acggccgattgttggaaagcggcac

SEQ ID NO: 725533 - DNA, 25 bp, Artificial sequence
  Synthetic oligonucleotide
gaggcggaatcgaaagggctgacct

SEQ ID NO: 725534 - DNA, 25 bp, Artificial sequence
  Synthetic oligonucleotide
tcggccgcatgcacggccgattgtt

SEQ ID NO: 725535 - DNA, 25 bp, Artificial sequence
  Synthetic oligonucleotide
agcgcttcggccgcatgcacggccg

SEQ ID NO: 725536 - DNA, 25 bp, Artificial sequence
  Synthetic oligonucleotide
tgggcaagcgcttcggccgcatgca

SEQ ID NO: 725537 - DNA, 25 bp, Artificial sequence
  Synthetic oligonucleotide
gggttctgggcaagcgcttcggccg

SEQ ID NO: 725538 - DNA, 25 bp, Artificial sequence
  Synthetic oligonucleotide
tgtacggggttctgggcaagcgctt

SEQ ID NO: 725539 - DNA, 25 bp, Artificial sequence
  Synthetic oligonucleotide
tccgtctgtacggggttctgggcaa

SEQ ID NO: 725540 - DNA, 25 bp, Artificial sequence
  Synthetic oligonucleotide
caccatccgtctgtacggggttctg

SEQ ID NO: 725541 - DNA, 25 bp, Artificial sequence
  Synthetic oligonucleotide
cctcaccaccatccgtctgtacggg

SEQ ID NO: 725542 - DNA, 25 bp, Artificial sequence
  Synthetic oligonucleotide
cagggcctcaccaccatccgtctgt

SEQ ID NO: 725543 - DNA, 25 bp, Artificial sequence
  Synthetic oligonucleotide
ctgagtcagggcctcaccaccatcc

SEQ ID NO: 725544 - DNA, 25 bp, Artificial sequence
  Synthetic oligonucleotide
gacaccctgagtcagggcctcacca

SEQ ID NO: 725545 - DNA, 25 bp, Artificial sequence
  Synthetic oligonucleotide
atgagtgacaccctgagtcagggcc

SEQ ID NO: 725546 - DNA, 25 bp, Artificial sequence
  Synthetic oligonucleotide
cgattgttggaaagcggcacggtac

SEQ ID NO: 725547 - DNA, 25 bp, Artificial sequence
  Synthetic oligonucleotide
tgcgcggacgcgaggatatccgcat

SEQ ID NO: 725548 - DNA, 25 bp, Artificial sequence
  Synthetic oligonucleotide
gaagccgcgccagccggtggagatg

SEQ ID NO: 725549 - DNA, 25 bp, Artificial sequence
  Synthetic oligonucleotide
gggggctgccttgattgtcgtgggt

SEQ ID NO: 725550 - DNA, 25 bp, Artificial sequence
  Synthetic oligonucleotide
gattctgggggctgccttgattgtc

SEQ ID NO: 725551 - DNA, 25 bp, Artificial sequence
  Synthetic oligonucleotide
ccagacgattctgggggctgccttg

SEQ ID NO: 725552 - DNA, 25 bp, Artificial sequence
  Synthetic oligonucleotide
cttttccagacgattctgggggctg

SEQ ID NO: 725553 - DNA, 25 bp, Artificial sequence
  Synthetic oligonucleotide
ggcggggcttttccagacgattctg

SEQ ID NO: 725554 - DNA, 25 bp, Artificial sequence
  Synthetic oligonucleotide
caagcaggcggggcttttccagacg

SEQ ID NO: 725555 - DNA, 25 bp, Artificial sequence
  Synthetic oligonucleotide
cgggagcaagcaggcggggcttttc

SEQ ID NO: 725556 - DNA, 25 bp, Artificial sequence
  Synthetic oligonucleotide
gtgatcgggagcaagcaggcggggc

SEQ ID NO: 725557 - DNA, 25 bp, Artificial sequence
  Synthetic oligonucleotide
cgttggtgatcgggagcaagcaggc

SEQ ID NO: 725558 - DNA, 25 bp, Artificial sequence
  Synthetic oligonucleotide
tcgtgccgttggtgatcgggagcaa

SEQ ID NO: 725559 - DNA, 25 bp, Artificial sequence
  Synthetic oligonucleotide
tccgcatcgtgccgttggtgatcgg

SEQ ID NO: 725560 - DNA, 25 bp, Artificial sequence
  Synthetic oligonucleotide
acgttcatgcgcgaggcggaatcga

SEQ ID NO: 725561 - DNA, 25 bp, Artificial sequence
  Synthetic oligonucleotide
gacgcgaggatatccgcatcgtgcc

SEQ ID NO: 725562 - DNA, 25 bp, Artificial sequence
  Synthetic oligonucleotide
atgcgcgaggcggaatcgaaagggc

SEQ ID NO: 725563 - DNA, 25 bp, Artificial sequence
  Synthetic oligonucleotide
tggacatgcgcggacgcgaggatat

SEQ ID NO: 725564 - DNA, 25 bp, Artificial sequence
  Synthetic oligonucleotide
agcaactggacatgcgcggacgcga

SEQ ID NO: 725565 - DNA, 25 bp, Artificial sequence
  Synthetic oligonucleotide
ccggcgagcaactggacatgcgcgg

SEQ ID NO: 725566 - DNA, 25 bp, Artificial sequence
  Synthetic oligonucleotide
acctgtccggcgagcaactggacat

SEQ ID NO: 725567 - DNA, 25 bp, Artificial sequence
  Synthetic oligonucleotide
gtaccaacctgtccggcgagcaact

SEQ ID NO: 725568 - DNA, 25 bp, Artificial sequence
  Synthetic oligonucleotide
gtgggcgtaccaacctgtccggcga

SEQ ID NO: 725569 - DNA, 25 bp, Artificial sequence
  Synthetic oligonucleotide
tgttccgtgggcgtaccaacctgtc

SEQ ID NO: 725570 - DNA, 25 bp, Artificial sequence
  Synthetic oligonucleotide
tcgccgtgttccgtgggcgtaccaa

SEQ ID NO: 725571 - DNA, 25 bp, Artificial sequence
  Synthetic oligonucleotide
tgaccttcgccgtgttccgtgggcg

SEQ ID NO: 725572 - DNA, 25 bp, Artificial sequence
  Synthetic oligonucleotide
aagggctgaccttcgccgtgttccg

SEQ ID NO: 725573 - DNA, 25 bp, Artificial sequence
  Synthetic oligonucleotide
gaatcgaaagggctgaccttcgccg

SEQ ID NO: 725574 - DNA, 25 bp, Artificial sequence
  Synthetic oligonucleotide
attgtcgtgggtggattcacgacgt

SEQ ID NO: 725575 - DNA, 25 bp, Artificial sequence
  Synthetic oligonucleotide
aggatatccgcatcgtgccgttggt

SEQ ID NO: 725576 - DNA, 25 bp, Artificial sequence
  Synthetic oligonucleotide
ttcgctggacgacaagtccaccagc

SEQ ID NO: 725577 - DNA, 25 bp, Artificial sequence
  Synthetic oligonucleotide
aggtgcgcgtgcgccgcctgacgcc

SEQ ID NO: 725578 - DNA, 25 bp, Artificial sequence
  Synthetic oligonucleotide
gctggcaggtgcgcgtgcgccgcct

SEQ ID NO: 725579 - DNA, 25 bp, Artificial sequence
  Synthetic oligonucleotide
ggagcggctggcaggtgcgcgtgcg

SEQ ID NO: 725580 - DNA, 25 bp, Artificial sequence
  Synthetic oligonucleotide
aggcgcggagcggctggcaggtgcg

SEQ ID NO: 725581 - DNA, 25 bp, Artificial sequence
  Synthetic oligonucleotide
tgccggaggcgcggagcggctggca

SEQ ID NO: 725582 - DNA, 25 bp, Artificial sequence
  Synthetic oligonucleotide
tcgacctgccggaggcgcggagcgg

SEQ ID NO: 725583 - DNA, 25 bp, Artificial sequence
  Synthetic oligonucleotide
accgtgtcgacctgccggaggcgcg

SEQ ID NO: 725584 - DNA, 25 bp, Artificial sequence
  Synthetic oligonucleotide
gctcccaccgtgtcgacctgccgga

SEQ ID NO: 725585 - DNA, 25 bp, Artificial sequence
  Synthetic oligonucleotide
acgagcgctcccaccgtgtcgacct

SEQ ID NO: 725586 - DNA, 25 bp, Artificial sequence
  Synthetic oligonucleotide
gccgctacgagcgctcccaccgtgt

SEQ ID NO: 725587 - DNA, 25 bp, Artificial sequence
  Synthetic oligonucleotide
ccaccagccgctacgagcgctccca

SEQ ID NO: 725588 - DNA, 25 bp, Artificial sequence
  Synthetic oligonucleotide
gacgtggtcggctaccgcatcgact

SEQ ID NO: 725589 - DNA, 25 bp, Artificial sequence
  Synthetic oligonucleotide
tggacgacaagtccaccagccgcta

SEQ ID NO: 725590 - DNA, 25 bp, Artificial sequence
  Synthetic oligonucleotide
tgacgccgaaccagaacaacaaccg

SEQ ID NO: 725591 - DNA, 25 bp, Artificial sequence
  Synthetic oligonucleotide
aaggcttcgctggacgacaagtcca

SEQ ID NO: 725592 - DNA, 25 bp, Artificial sequence
  Synthetic oligonucleotide
gcgctgaaggcttcgctggacgaca

SEQ ID NO: 725593 - DNA, 25 bp, Artificial sequence
  Synthetic oligonucleotide
caggaagcgctgaaggcttcgctgg

SEQ ID NO: 725594 - DNA, 25 bp, Artificial sequence
  Synthetic oligonucleotide
gcctggcaggaagcgctgaaggctt

SEQ ID NO: 725595 - DNA, 25 bp, Artificial sequence
  Synthetic oligonucleotide
ggcggtgcctggcaggaagcgctga

SEQ ID NO: 725596 - DNA, 25 bp, Artificial sequence
  Synthetic oligonucleotide
cgtcgacggcggtgcctggcaggaa

SEQ ID NO: 725597 - DNA, 25 bp, Artificial sequence
  Synthetic oligonucleotide
catcgccgtcgacggcggtgcctgg

SEQ ID NO: 725598 - DNA, 25 bp, Artificial sequence
  Synthetic oligonucleotide
atcgacatcgccgtcgacggcggtg

SEQ ID NO: 725599 - DNA, 25 bp, Artificial sequence
  Synthetic oligonucleotide
tacgcgatcgacatcgccgtcgacg

SEQ ID NO: 725600 - DNA, 25 bp, Artificial sequence
  Synthetic oligonucleotide
atcgactacgcgatcgacatcgccg

SEQ ID NO: 725601 - DNA, 25 bp, Artificial sequence
  Synthetic oligonucleotide
taccgcatcgactacgcgatcgaca

SEQ ID NO: 725602 - DNA, 25 bp, Artificial sequence
  Synthetic oligonucleotide
gggtggcagcaagaagccgcgccag

SEQ ID NO: 725603 - DNA, 25 bp, Artificial sequence
  Synthetic oligonucleotide
acaagtccaccagccgctacgagcg

SEQ ID NO: 725604 - DNA, 25 bp, Artificial sequence
  Synthetic oligonucleotide
ccaagctgcgctacccgaacaccgc

SEQ ID NO: 725605 - DNA, 25 bp, Artificial sequence
  Synthetic oligonucleotide
cagcagtgtggagaccgctcttgag

SEQ ID NO: 725606 - DNA, 25 bp, Artificial sequence
  Synthetic oligonucleotide
tcggtggaagcgcgcggccggcggg

SEQ ID NO: 725607 - DNA, 25 bp, Artificial sequence
  Synthetic oligonucleotide
cagatatcggtggaagcgcgcggcc

SEQ ID NO: 725608 - DNA, 25 bp, Artificial sequence
  Synthetic oligonucleotide
attccgcagatatcggtggaagcgc

SEQ ID NO: 725609 - DNA, 25 bp, Artificial sequence
  Synthetic oligonucleotide
cagagcattccgcagatatcggtgg

SEQ ID NO: 725610 - DNA, 25 bp, Artificial sequence
  Synthetic oligonucleotide
cagttccagagcattccgcagatat

SEQ ID NO: 725611 - DNA, 25 bp, Artificial sequence
  Synthetic oligonucleotide
gccagccagttccagagcattccgc

SEQ ID NO: 725612 - DNA, 25 bp, Artificial sequence
  Synthetic oligonucleotide
ttcgatgccagccagttccagagca

SEQ ID NO: 725613 - DNA, 25 bp, Artificial sequence
  Synthetic oligonucleotide
gtcgagttcgatgccagccagttcc

SEQ ID NO: 725614 - DNA, 25 bp, Artificial sequence
  Synthetic oligonucleotide
tgttcgtcgagttcgatgccagcca

SEQ ID NO: 725615 - DNA, 25 bp, Artificial sequence
  Synthetic oligonucleotide
cgctgctgttcgtcgagttcgatgc

SEQ ID NO: 725616 - DNA, 25 bp, Artificial sequence
  Synthetic oligonucleotide
acaccgcgctgctgttcgtcgagtt

SEQ ID NO: 725617 - DNA, 25 bp, Artificial sequence
  Synthetic oligonucleotide
gcgtgcgccgcctgacgccgaacca

SEQ ID NO: 725618 - DNA, 25 bp, Artificial sequence
  Synthetic oligonucleotide
tgcgctacccgaacaccgcgctgct

SEQ ID NO: 725619 - DNA, 25 bp, Artificial sequence
  Synthetic oligonucleotide
gccgcctgacgccgaaccagaacaa

SEQ ID NO: 725620 - DNA, 25 bp, Artificial sequence
  Synthetic oligonucleotide
tcgacgccaagctgcgctacccgaa

SEQ ID NO: 725621 - DNA, 25 bp, Artificial sequence
  Synthetic oligonucleotide
aggtgatcgacgccaagctgcgcta

SEQ ID NO: 725622 - DNA, 25 bp, Artificial sequence
  Synthetic oligonucleotide
tcaccgaggtgatcgacgccaagct

SEQ ID NO: 725623 - DNA, 25 bp, Artificial sequence
  Synthetic oligonucleotide
aggcgatcaccgaggtgatcgacgc

SEQ ID NO: 725624 - DNA, 25 bp, Artificial sequence
  Synthetic oligonucleotide
gggtggaggcgatcaccgaggtgat

SEQ ID NO: 725625 - DNA, 25 bp, Artificial sequence
  Synthetic oligonucleotide
ccatgcgggtggaggcgatcaccga

SEQ ID NO: 725626 - DNA, 25 bp, Artificial sequence
  Synthetic oligonucleotide
ccgacaccatgcgggtggaggcgat

SEQ ID NO: 725627 - DNA, 25 bp, Artificial sequence
  Synthetic oligonucleotide
gcgtcgccgacaccatgcgggtgga

SEQ ID NO: 725628 - DNA, 25 bp, Artificial sequence
  Synthetic oligonucleotide
acaaccgcgtcgccgacaccatgcg

SEQ ID NO: 725629 - DNA, 25 bp, Artificial sequence
  Synthetic oligonucleotide
agaacaacaaccgcgtcgccgacac

SEQ ID NO: 725630 - DNA, 25 bp, Artificial sequence
  Synthetic oligonucleotide
cgaaccagaacaacaaccgcgtcgc

SEQ ID NO: 725631 - DNA, 25 bp, Artificial sequence
  Synthetic oligonucleotide
aacggtgacgtggtcggctaccgca

SEQ ID NO: 725632 - DNA, 25 bp, Artificial sequence
  Synthetic oligonucleotide
acccgaacaccgcgctgctgttcgt

SEQ ID NO: 725633 - DNA, 25 bp, Artificial sequence
  Synthetic oligonucleotide
tgggcgaaggcgagttcgacggtgg

SEQ ID NO: 725634 - DNA, 25 bp, Artificial sequence
  Synthetic oligonucleotide
cggtgaacttccccggagtgacctg

SEQ ID NO: 725635 - DNA, 25 bp, Artificial sequence
  Synthetic oligonucleotide
cggctcggtgaacttccccggagtg

SEQ ID NO: 725636 - DNA, 25 bp, Artificial sequence
  Synthetic oligonucleotide
gcggcggacggctcggtgaacttcc

SEQ ID NO: 725637 - DNA, 25 bp, Artificial sequence
  Synthetic oligonucleotide
ctgctggcggcggacggctcggtga

SEQ ID NO: 725638 - DNA, 25 bp, Artificial sequence
  Synthetic oligonucleotide
tacgccgctgctggcggcggacggc

SEQ ID NO: 725639 - DNA, 25 bp, Artificial sequence
  Synthetic oligonucleotide
gacgatacgccgctgctggcggcgg

SEQ ID NO: 725640 - DNA, 25 bp, Artificial sequence
  Synthetic oligonucleotide
ctacctggacgatacgccgctgctg

SEQ ID NO: 725641 - DNA, 25 bp, Artificial sequence
  Synthetic oligonucleotide
ttcgatctacctggacgatacgccg

SEQ ID NO: 725642 - DNA, 25 bp, Artificial sequence
  Synthetic oligonucleotide
cggccgttcgatctacctggacgat

SEQ ID NO: 725643 - DNA, 25 bp, Artificial sequence
  Synthetic oligonucleotide
cgtcgacggccgttcgatctacctg

SEQ ID NO: 725644 - DNA, 25 bp, Artificial sequence
  Synthetic oligonucleotide
acggtggcgtcgacggccgttcgat

SEQ ID NO: 725645 - DNA, 25 bp, Artificial sequence
  Synthetic oligonucleotide
gtcggctaccgcatcgactacgcga

SEQ ID NO: 725646 - DNA, 25 bp, Artificial sequence
  Synthetic oligonucleotide
aaggcgagttcgacggtggcgtcga

SEQ ID NO: 725647 - DNA, 25 bp, Artificial sequence
  Synthetic oligonucleotide
tccgtccgggctcggtggaccagga

SEQ ID NO: 725648 - DNA, 25 bp, Artificial sequence
  Synthetic oligonucleotide
tggcactgggcgaaggcgagttcga

SEQ ID NO: 725649 - DNA, 25 bp, Artificial sequence
  Synthetic oligonucleotide
ttctcctggcactgggcgaaggcga

SEQ ID NO: 725650 - DNA, 25 bp, Artificial sequence
  Synthetic oligonucleotide
gaagattctcctggcactgggcgaa

SEQ ID NO: 725651 - DNA, 25 bp, Artificial sequence
  Synthetic oligonucleotide
gcgggcgaagattctcctggcactg

SEQ ID NO: 725652 - DNA, 25 bp, Artificial sequence
  Synthetic oligonucleotide
gatcgcgcgggcgaagattctcctg

SEQ ID NO: 725653 - DNA, 25 bp, Artificial sequence
  Synthetic oligonucleotide
tgcgctcgatcgcgcgggcgaagat

SEQ ID NO: 725654 - DNA, 25 bp, Artificial sequence
  Synthetic oligonucleotide
actcggtgcgctcgatcgcgcgggc

SEQ ID NO: 725655 - DNA, 25 bp, Artificial sequence
  Synthetic oligonucleotide
tgccggactcggtgcgctcgatcgc

SEQ ID NO: 725656 - DNA, 25 bp, Artificial sequence
  Synthetic oligonucleotide
tggagatgccggactcggtgcgctc

SEQ ID NO: 725657 - DNA, 25 bp, Artificial sequence
  Synthetic oligonucleotide
agccggtggagatgccggactcggt

SEQ ID NO: 725658 - DNA, 25 bp, Artificial sequence
  Synthetic oligonucleotide
gcgccagccggtggagatgccggac

SEQ ID NO: 725659 - DNA, 25 bp, Artificial sequence
  Synthetic oligonucleotide
cgcggccggcgggtgcgggtgccga

SEQ ID NO: 725660 - DNA, 25 bp, Artificial sequence
  Synthetic oligonucleotide
agttcgacggtggcgtcgacggccg

SEQ ID NO: 725661 - DNA, 25 bp, Artificial sequence
  Synthetic oligonucleotide
gtgacgcgccctgggtccgcgcggt

SEQ ID NO: 725662 - DNA, 25 bp, Artificial sequence
  Synthetic oligonucleotide
agcaggaaaacggtgacgtggtcgg

SEQ ID NO: 725663 - DNA, 25 bp, Artificial sequence
  Synthetic oligonucleotide
agcgccagcaggaaaacggtgacgt

SEQ ID NO: 725664 - DNA, 25 bp, Artificial sequence
  Synthetic oligonucleotide
ccatccagcgccagcaggaaaacgg

SEQ ID NO: 725665 - DNA, 25 bp, Artificial sequence
  Synthetic oligonucleotide
ggccggccatccagcgccagcagga

SEQ ID NO: 725666 - DNA, 25 bp, Artificial sequence
  Synthetic oligonucleotide
gtcctggccggccatccagcgccag

SEQ ID NO: 725667 - DNA, 25 bp, Artificial sequence
  Synthetic oligonucleotide
tgcgcctgtcctggccggccatcca

SEQ ID NO: 725668 - DNA, 25 bp, Artificial sequence
  Synthetic oligonucleotide
tgcgcctgcgcctgtcctggccggc

SEQ ID NO: 725669 - DNA, 25 bp, Artificial sequence
  Synthetic oligonucleotide
cggcggtgcgcctgcgcctgtcctg

SEQ ID NO: 725670 - DNA, 25 bp, Artificial sequence
  Synthetic oligonucleotide
agctctcggcggtgcgcctgcgcct

SEQ ID NO: 725671 - DNA, 25 bp, Artificial sequence
  Synthetic oligonucleotide
acacccagctctcggcggtgcgcct

SEQ ID NO: 725672 - DNA, 25 bp, Artificial sequence
  Synthetic oligonucleotide
tgaacaacacccagctctcggcggt

SEQ ID NO: 725673 - DNA, 25 bp, Artificial sequence
  Synthetic oligonucleotide
gcgcggtgaacaacacccagctctc

SEQ ID NO: 725674 - DNA, 25 bp, Artificial sequence
  Synthetic oligonucleotide
cggagtgacctgggagttccgtccg

SEQ ID NO: 725675 - DNA, 25 bp, Artificial sequence
  Synthetic oligonucleotide
cgccctgggtccgcgcggtgaacaa

SEQ ID NO: 725676 - DNA, 25 bp, Artificial sequence
  Synthetic oligonucleotide
tgacctgggagttccgtccgggctc

SEQ ID NO: 725677 - DNA, 25 bp, Artificial sequence
  Synthetic oligonucleotide
tcaagagtgacgcgccctgggtccg

SEQ ID NO: 725678 - DNA, 25 bp, Artificial sequence
  Synthetic oligonucleotide
tcgaactcaagagtgacgcgccctg

SEQ ID NO: 725679 - DNA, 25 bp, Artificial sequence
  Synthetic oligonucleotide
tcggcgtcgaactcaagagtgacgc

SEQ ID NO: 725680 - DNA, 25 bp, Artificial sequence
  Synthetic oligonucleotide
tggcggtcggcgtcgaactcaagag

SEQ ID NO: 725681 - DNA, 25 bp, Artificial sequence
  Synthetic oligonucleotide
acgaactggcggtcggcgtcgaact

SEQ ID NO: 725682 - DNA, 25 bp, Artificial sequence
  Synthetic oligonucleotide
tgtgcccgccgtggaaaacgaactg

SEQ ID NO: 725683 - DNA, 25 bp, Artificial sequence
  Synthetic oligonucleotide
ttgccggtgtgcccgccgtggaaaa

SEQ ID NO: 725684 - DNA, 25 bp, Artificial sequence
  Synthetic oligonucleotide
aacacattgccggtgtgcccgccgt

SEQ ID NO: 725685 - DNA, 25 bp, Artificial sequence
  Synthetic oligonucleotide
accaggaacacattgccggtgtgcc

SEQ ID NO: 725686 - DNA, 25 bp, Artificial sequence
  Synthetic oligonucleotide
cggtggaccaggaacacattgccgg

SEQ ID NO: 725687 - DNA, 25 bp, Artificial sequence
  Synthetic oligonucleotide
cgggctcggtggaccaggaacacat

SEQ ID NO: 725688 - DNA, 25 bp, Artificial sequence
  Synthetic oligonucleotide
cagcaagaagccgcgccagccggtg

SEQ ID NO: 725689 - DNA, 25 bp, Artificial sequence
  Synthetic oligonucleotide
gggtccgcgcggtgaacaacaccca

SEQ ID NO: 725690 - DNA, 25 bp, Artificial sequence
  Synthetic oligonucleotide
gtaaggaatggcttggggcagactg

SEQ ID NO: 725691 - DNA, 25 bp, Artificial sequence
  Synthetic oligonucleotide
catccggctccgtaagaattagagt

SEQ ID NO: 725692 - DNA, 25 bp, Artificial sequence
  Synthetic oligonucleotide
ttgaagtcgagacaagtcagtggtt

SEQ ID NO: 725693 - DNA, 25 bp, Artificial sequence
  Synthetic oligonucleotide
gaaatattgaagtcgagacaagtca

SEQ ID NO: 725694 - DNA, 25 bp, Artificial sequence
  Synthetic oligonucleotide
tggaaagaaatattgaagtcgagac

SEQ ID NO: 725695 - DNA, 25 bp, Artificial sequence
  Synthetic oligonucleotide
ttctgttggaaagaaatattgaagt

SEQ ID NO: 725696 - DNA, 25 bp, Artificial sequence
  Synthetic oligonucleotide
tttctcttctgttggaaagaaatat

SEQ ID NO: 725697 - DNA, 25 bp, Artificial sequence
  Synthetic oligonucleotide
ataacctttctcttctgttggaaag

SEQ ID NO: 725698 - DNA, 25 bp, Artificial sequence
  Synthetic oligonucleotide
agtttcataacctttctcttctgtt

SEQ ID NO: 725699 - DNA, 25 bp, Artificial sequence
  Synthetic oligonucleotide
atggagagtttcataacctttctct

SEQ ID NO: 725700 - DNA, 25 bp, Artificial sequence
  Synthetic oligonucleotide
taatagatggagagtttcataacct

SEQ ID NO: 725701 - DNA, 25 bp, Artificial sequence
  Synthetic oligonucleotide
agactgtaatagatggagagtttca

SEQ ID NO: 725702 - DNA, 25 bp, Artificial sequence
  Synthetic oligonucleotide
caagtcagtggttctcactggattt

SEQ ID NO: 725703 - DNA, 25 bp, Artificial sequence
  Synthetic oligonucleotide
atggcttggggcagactgtaataga

SEQ ID NO: 725704 - DNA, 25 bp, Artificial sequence
  Synthetic oligonucleotide
agtggttctcactggattttccata

SEQ ID NO: 725705 - DNA, 25 bp, Artificial sequence
  Synthetic oligonucleotide
gtcttggtaaggaatggcttggggc

SEQ ID NO: 725706 - DNA, 25 bp, Artificial sequence
  Synthetic oligonucleotide
agtatggggtcttggtaaggaatgg

SEQ ID NO: 725707 - DNA, 25 bp, Artificial sequence
  Synthetic oligonucleotide
tgagtgagtatggggtcttggtaag

SEQ ID NO: 725708 - DNA, 25 bp, Artificial sequence
  Synthetic oligonucleotide
aggtatgagtgagtatggggtcttg

SEQ ID NO: 725709 - DNA, 25 bp, Artificial sequence
  Synthetic oligonucleotide
tggccaaggtatgagtgagtatggg

SEQ ID NO: 725710 - DNA, 25 bp, Artificial sequence
  Synthetic oligonucleotide
tgtggtggccaaggtatgagtgagt

SEQ ID NO: 725711 - DNA, 25 bp, Artificial sequence
  Synthetic oligonucleotide
cttatatgtggtggccaaggtatga

SEQ ID NO: 725712 - DNA, 25 bp, Artificial sequence
  Synthetic oligonucleotide
tggaaccttatatgtggtggccaag

SEQ ID NO: 725713 - DNA, 25 bp, Artificial sequence
  Synthetic oligonucleotide
tacttctggaaccttatatgtggtg

SEQ ID NO: 725714 - DNA, 25 bp, Artificial sequence
  Synthetic oligonucleotide
attccatacttctggaaccttatat

SEQ ID NO: 725715 - DNA, 25 bp, Artificial sequence
  Synthetic oligonucleotide
atcactattccatacttctggaacc

SEQ ID NO: 725716 - DNA, 25 bp, Artificial sequence
  Synthetic oligonucleotide
gtggccatcactattccatacttct

SEQ ID NO: 725717 - DNA, 25 bp, Artificial sequence
  Synthetic oligonucleotide
tggggcagactgtaatagatggaga

SEQ ID NO: 725718 - DNA, 25 bp, Artificial sequence
  Synthetic oligonucleotide
ttacttcgactcagtacagtatcga

SEQ ID NO: 725719 - DNA, 25 bp, Artificial sequence
  Synthetic oligonucleotide
tcggtctacgccagcagtgtggaga

SEQ ID NO: 725720 - DNA, 25 bp, Artificial sequence
  Synthetic oligonucleotide
atggaacacatacatccggctccgt

SEQ ID NO: 725721 - DNA, 25 bp, Artificial sequence
  Synthetic oligonucleotide
cagggtatggaacacatacatccgg

SEQ ID NO: 725722 - DNA, 25 bp, Artificial sequence
  Synthetic oligonucleotide
gtttttcagggtatggaacacatac

SEQ ID NO: 725723 - DNA, 25 bp, Artificial sequence
  Synthetic oligonucleotide
ctctgagtttttcagggtatggaac

SEQ ID NO: 725724 - DNA, 25 bp, Artificial sequence
  Synthetic oligonucleotide
gcgccactctgagtttttcagggta

SEQ ID NO: 725725 - DNA, 25 bp, Artificial sequence
  Synthetic oligonucleotide
ggacaggcgccactctgagtttttc

SEQ ID NO: 725726 - DNA, 25 bp, Artificial sequence
  Synthetic oligonucleotide
ggaaactggacaggcgccactctga

SEQ ID NO: 725727 - DNA, 25 bp, Artificial sequence
  Synthetic oligonucleotide
gggccgggaaactggacaggcgcca

SEQ ID NO: 725728 - DNA, 25 bp, Artificial sequence
  Synthetic oligonucleotide
cgaggtgggccgggaaactggacag

SEQ ID NO: 725729 - DNA, 25 bp, Artificial sequence
  Synthetic oligonucleotide
agtatcgaggtgggccgggaaactg

SEQ ID NO: 725730 - DNA, 25 bp, Artificial sequence
  Synthetic oligonucleotide
tcgagacaagtcagtggttctcact

SEQ ID NO: 725731 - DNA, 25 bp, Artificial sequence
  Synthetic oligonucleotide
cgactcagtacagtatcgaggtggg

SEQ ID NO: 725732 - DNA, 25 bp, Artificial sequence
  Synthetic oligonucleotide
atggggctacgaggattggtggcca

SEQ ID NO: 725733 - DNA, 25 bp, Artificial sequence
  Synthetic oligonucleotide
aattctttacttcgactcagtacag

SEQ ID NO: 725734 - DNA, 25 bp, Artificial sequence
  Synthetic oligonucleotide
gaataaaattctttacttcgactca

SEQ ID NO: 725735 - DNA, 25 bp, Artificial sequence
  Synthetic oligonucleotide
agttcaagcttggaagaataaaatt

SEQ ID NO: 725736 - DNA, 25 bp, Artificial sequence
  Synthetic oligonucleotide
tctagcagttcaagcttggaagaat

SEQ ID NO: 725737 - DNA, 25 bp, Artificial sequence
  Synthetic oligonucleotide
tcctgttctagcagttcaagcttgg

SEQ ID NO: 725738 - DNA, 25 bp, Artificial sequence
  Synthetic oligonucleotide
tgcacctcctgttctagcagttcaa

SEQ ID NO: 725739 - DNA, 25 bp, Artificial sequence
  Synthetic oligonucleotide
atcagctgcacctcctgttctagca

SEQ ID NO: 725740 - DNA, 25 bp, Artificial sequence
  Synthetic oligonucleotide
ggtcacatcagctgcacctcctgtt

SEQ ID NO: 725741 - DNA, 25 bp, Artificial sequence
  Synthetic oligonucleotide
tatgcggtcacatcagctgcacctc

SEQ ID NO: 725742 - DNA, 25 bp, Artificial sequence
  Synthetic oligonucleotide
ttccatatgcggtcacatcagctgc

SEQ ID NO: 725743 - DNA, 25 bp, Artificial sequence
  Synthetic oligonucleotide
tggattttccatatgcggtcacatc

SEQ ID NO: 725744 - DNA, 25 bp, Artificial sequence
  Synthetic oligonucleotide
tctcactggattttccatatgcggt

SEQ ID NO: 725745 - DNA, 25 bp, Artificial sequence
  Synthetic oligonucleotide
agtacagtatcgaggtgggccggga

SEQ ID NO: 725746 - DNA, 25 bp, Artificial sequence
  Synthetic oligonucleotide
aggtcagagttgagatggggctttt

SEQ ID NO: 725747 - DNA, 25 bp, Artificial sequence
  Synthetic oligonucleotide
tgtagatataactgacagggcgttg

SEQ ID NO: 725748 - DNA, 25 bp, Artificial sequence
  Synthetic oligonucleotide
cgccgctgtagatataactgacagg

SEQ ID NO: 725749 - DNA, 25 bp, Artificial sequence
  Synthetic oligonucleotide
tgggaccgccgctgtagatataact

SEQ ID NO: 725750 - DNA, 25 bp, Artificial sequence
  Synthetic oligonucleotide
agagaatgggaccgccgctgtagat

SEQ ID NO: 725751 - DNA, 25 bp, Artificial sequence
  Synthetic oligonucleotide
ctatcgagagaatgggaccgccgct

SEQ ID NO: 725752 - DNA, 25 bp, Artificial sequence
  Synthetic oligonucleotide
acgtatctatcgagagaatgggacc

SEQ ID NO: 725753 - DNA, 25 bp, Artificial sequence
  Synthetic oligonucleotide
tggattacgtatctatcgagagaat

SEQ ID NO: 725754 - DNA, 25 bp, Artificial sequence
  Synthetic oligonucleotide
tatctatggattacgtatctatcga

SEQ ID NO: 725755 - DNA, 25 bp, Artificial sequence
  Synthetic oligonucleotide
catgagtatctatggattacgtatc

SEQ ID NO: 725756 - DNA, 25 bp, Artificial sequence
  Synthetic oligonucleotide
tacagtcatgagtatctatggatta

SEQ ID NO: 725757 - DNA, 25 bp, Artificial sequence
  Synthetic oligonucleotide
ggcttttacagtcatgagtatctat

SEQ ID NO: 725758 - DNA, 25 bp, Artificial sequence
  Synthetic oligonucleotide
ggattggtggccatcactattccat

SEQ ID NO: 725759 - DNA, 25 bp, Artificial sequence
  Synthetic oligonucleotide
gagttgagatggggcttttacagtc

SEQ ID NO: 725760 - DNA, 25 bp, Artificial sequence
  Synthetic oligonucleotide
ggcgttgcgggttgtatattccaga

SEQ ID NO: 725761 - DNA, 25 bp, Artificial sequence
  Synthetic oligonucleotide
caggccaggtcagagttgagatggg

SEQ ID NO: 725762 - DNA, 25 bp, Artificial sequence
  Synthetic oligonucleotide
cagtgcaggccaggtcagagttgag

SEQ ID NO: 725763 - DNA, 25 bp, Artificial sequence
  Synthetic oligonucleotide
acgagacagtgcaggccaggtcaga

SEQ ID NO: 725764 - DNA, 25 bp, Artificial sequence
  Synthetic oligonucleotide
acagtacgagacagtgcaggccagg

SEQ ID NO: 725765 - DNA, 25 bp, Artificial sequence
  Synthetic oligonucleotide
acttatacagtacgagacagtgcag

SEQ ID NO: 725766 - DNA, 25 bp, Artificial sequence
  Synthetic oligonucleotide
gcgggtacttatacagtacgagaca

SEQ ID NO: 725767 - DNA, 25 bp, Artificial sequence
  Synthetic oligonucleotide
gataaagcgggtacttatacagtac

SEQ ID NO: 725768 - DNA, 25 bp, Artificial sequence
  Synthetic oligonucleotide
aggctggataaagcgggtacttata

SEQ ID NO: 725769 - DNA, 25 bp, Artificial sequence
  Synthetic oligonucleotide
tatggaggctggataaagcgggtac

SEQ ID NO: 725770 - DNA, 25 bp, Artificial sequence
  Synthetic oligonucleotide
tgccgatatggaggctggataaagc

SEQ ID NO: 725771 - DNA, 25 bp, Artificial sequence
  Synthetic oligonucleotide
cggtatgccgatatggaggctggat

SEQ ID NO: 725772 - DNA, 25 bp, Artificial sequence
  Synthetic oligonucleotide
caataacggtatgccgatatggagg

SEQ ID NO: 725773 - DNA, 25 bp, Artificial sequence
  Synthetic oligonucleotide
agatggggcttttacagtcatgagt

SEQ ID NO: 725774 - DNA, 25 bp, Artificial sequence
  Synthetic oligonucleotide
cccgaacaatgcttccgtctacgtg

SEQ ID NO: 725775 - DNA, 25 bp, Artificial sequence
  Synthetic oligonucleotide
gctccgtaagaattagagtttatgc

SEQ ID NO: 725776 - DNA, 25 bp, Artificial sequence
  Synthetic oligonucleotide
tgttcaatggggctacgaggattgg

SEQ ID NO: 725777 - DNA, 25 bp, Artificial sequence
  Synthetic oligonucleotide
tggcgttgttcaatggggctacgag

SEQ ID NO: 725778 - DNA, 25 bp, Artificial sequence
  Synthetic oligonucleotide
gggtgatggcgttgttcaatggggc

SEQ ID NO: 725779 - DNA, 25 bp, Artificial sequence
  Synthetic oligonucleotide
ccgaatgggtgatggcgttgttcaa

SEQ ID NO: 725780 - DNA, 25 bp, Artificial sequence
  Synthetic oligonucleotide
ctgggcccgaatgggtgatggcgtt

SEQ ID NO: 725781 - DNA, 25 bp, Artificial sequence
  Synthetic oligonucleotide
tccggtctgggcccgaatgggtgat

SEQ ID NO: 725782 - DNA, 25 bp, Artificial sequence
  Synthetic oligonucleotide
ataagcgtccggtctgggcccgaat

SEQ ID NO: 725783 - DNA, 25 bp, Artificial sequence
  Synthetic oligonucleotide
gcacaataagcgtccggtctgggcc

SEQ ID NO: 725784 - DNA, 25 bp, Artificial sequence
  Synthetic oligonucleotide
tgatgagcacaataagcgtccggtc

SEQ ID NO: 725785 - DNA, 25 bp, Artificial sequence
  Synthetic oligonucleotide
gattggtgatgagcacaataagcgt

SEQ ID NO: 725786 - DNA, 25 bp, Artificial sequence
  Synthetic oligonucleotide
ctacgtgattggtgatgagcacaat

SEQ ID NO: 725787 - DNA, 25 bp, Artificial sequence
  Synthetic oligonucleotide
tataactgacagggcgttgcgggtt

SEQ ID NO: 725788 - DNA, 25 bp, Artificial sequence
  Synthetic oligonucleotide
caatgcttccgtctacgtgattggt

SEQ ID NO: 725789 - DNA, 25 bp, Artificial sequence
  Synthetic oligonucleotide
tgacagggcgttgcgggttgtatat

SEQ ID NO: 725790 - DNA, 25 bp, Artificial sequence
  Synthetic oligonucleotide
ctttggcccgaacaatgcttccgtc

SEQ ID NO: 725791 - DNA, 25 bp, Artificial sequence
  Synthetic oligonucleotide
gcccggctttggcccgaacaatgct

SEQ ID NO: 725792 - DNA, 25 bp, Artificial sequence
  Synthetic oligonucleotide
ctgccacgcccggctttggcccgaa

SEQ ID NO: 725793 - DNA, 25 bp, Artificial sequence
  Synthetic oligonucleotide
ggagaagctgccacgcccggctttg

SEQ ID NO: 725794 - DNA, 25 bp, Artificial sequence
  Synthetic oligonucleotide
tcgaaaggagaagctgccacgcccg

SEQ ID NO: 725795 - DNA, 25 bp, Artificial sequence
  Synthetic oligonucleotide
cagtttcgaaaggagaagctgccac

SEQ ID NO: 725796 - DNA, 25 bp, Artificial sequence
  Synthetic oligonucleotide
ttgatgcagtttcgaaaggagaagc

SEQ ID NO: 725797 - DNA, 25 bp, Artificial sequence
  Synthetic oligonucleotide
gacgggttgatgcagtttcgaaagg

SEQ ID NO: 725798 - DNA, 25 bp, Artificial sequence
  Synthetic oligonucleotide
attccagacgggttgatgcagtttc

SEQ ID NO: 725799 - DNA, 25 bp, Artificial sequence
  Synthetic oligonucleotide
ttgtatattccagacgggttgatgc

SEQ ID NO: 725800 - DNA, 25 bp, Artificial sequence
  Synthetic oligonucleotide
tgcgggttgtatattccagacgggt

SEQ ID NO: 725801 - DNA, 25 bp, Artificial sequence
  Synthetic oligonucleotide
ctacgaggattggtggccatcacta

SEQ ID NO: 725802 - DNA, 25 bp, Artificial sequence
  Synthetic oligonucleotide
ttccgtctacgtgattggtgatgag

SEQ ID NO: 725803 - DNA, 25 bp, Artificial sequence
  Synthetic oligonucleotide
gggagataatgctatggcttggcat

SEQ ID NO: 725804 - DNA, 25 bp, Artificial sequence
  Synthetic oligonucleotide
cacatacatccggctccgtaagaat

SEQ ID NO: 725805 - DNA, 25 bp, Artificial sequence
  Synthetic oligonucleotide
ttttatcgccaatgtgcgaaccggc

SEQ ID NO: 725806 - DNA, 25 bp, Artificial sequence
  Synthetic oligonucleotide
tactgattttatcgccaatgtgcga

SEQ ID NO: 725807 - DNA, 25 bp, Artificial sequence
  Synthetic oligonucleotide
aacgctactgattttatcgccaatg

SEQ ID NO: 725808 - DNA, 25 bp, Artificial sequence
  Synthetic oligonucleotide
ttaggaaacgctactgattttatcg

SEQ ID NO: 725809 - DNA, 25 bp, Artificial sequence
  Synthetic oligonucleotide
gcggtgttaggaaacgctactgatt

SEQ ID NO: 725810 - DNA, 25 bp, Artificial sequence
  Synthetic oligonucleotide
tccgaagcggtgttaggaaacgcta

SEQ ID NO: 725811 - DNA, 25 bp, Artificial sequence
  Synthetic oligonucleotide
ctgaattccgaagcggtgttaggaa

SEQ ID NO: 725812 - DNA, 25 bp, Artificial sequence
  Synthetic oligonucleotide
gtcacgctgaattccgaagcggtgt

SEQ ID NO: 725813 - DNA, 25 bp, Artificial sequence
  Synthetic oligonucleotide
gtttccgtcacgctgaattccgaag

SEQ ID NO: 725814 - DNA, 25 bp, Artificial sequence
  Synthetic oligonucleotide
aggttcggtttccgtcacgctgaat

SEQ ID NO: 725815 - DNA, 25 bp, Artificial sequence
  Synthetic oligonucleotide
atgtgcgaaccggcgatgcgttccg

SEQ ID NO: 725816 - DNA, 25 bp, Artificial sequence
  Synthetic oligonucleotide
taatgctatggcttggcattcgaaa

SEQ ID NO: 725817 - DNA, 25 bp, Artificial sequence
  Synthetic oligonucleotide
cgaaccggcgatgcgttccgtggcc

SEQ ID NO: 725818 - DNA, 25 bp, Artificial sequence
  Synthetic oligonucleotide
atttttgggagataatgctatggct

SEQ ID NO: 725819 - DNA, 25 bp, Artificial sequence
  Synthetic oligonucleotide
gagttgatttttgggagataatgct

SEQ ID NO: 725820 - DNA, 25 bp, Artificial sequence
  Synthetic oligonucleotide
aggcttgagttgatttttgggagat

SEQ ID NO: 725821 - DNA, 25 bp, Artificial sequence
  Synthetic oligonucleotide
taataaaggcttgagttgatttttg

SEQ ID NO: 725822 - DNA, 25 bp, Artificial sequence
  Synthetic oligonucleotide
ttccgataataaaggcttgagttga

SEQ ID NO: 725823 - DNA, 25 bp, Artificial sequence
  Synthetic oligonucleotide
cttcaattccgataataaaggcttg

SEQ ID NO: 725824 - DNA, 25 bp, Artificial sequence
  Synthetic oligonucleotide
ctatgccttcaattccgataataaa

SEQ ID NO: 725825 - DNA, 25 bp, Artificial sequence
  Synthetic oligonucleotide
attatgctatgccttcaattccgat

SEQ ID NO: 725826 - DNA, 25 bp, Artificial sequence
  Synthetic oligonucleotide
ctgtttattatgctatgccttcaat

SEQ ID NO: 725827 - DNA, 25 bp, Artificial sequence
  Synthetic oligonucleotide
cagctgctgtttattatgctatgcc

SEQ ID NO: 725828 - DNA, 25 bp, Artificial sequence
  Synthetic oligonucleotide
gaattccagctgctgtttattatgc

SEQ ID NO: 725829 - DNA, 25 bp, Artificial sequence
  Synthetic oligonucleotide
atcctggaattccagctgctgttta

SEQ ID NO: 725830 - DNA, 25 bp, Artificial sequence
  Synthetic oligonucleotide
tatggcttggcattcgaaaggttcg

SEQ ID NO: 725831 - DNA, 25 bp, Artificial sequence
  Synthetic oligonucleotide
tcaagcccaattatcagggtgcgac

SEQ ID NO: 725832 - DNA, 25 bp, Artificial sequence
  Synthetic oligonucleotide
ttggcagaccaattccgcgacatca

SEQ ID NO: 725833 - DNA, 25 bp, Artificial sequence
  Synthetic oligonucleotide
aaaaacttggcagaccaattccgcg

SEQ ID NO: 725834 - DNA, 25 bp, Artificial sequence
  Synthetic oligonucleotide
tattcaaaaaacttggcagaccaat

SEQ ID NO: 725835 - DNA, 25 bp, Artificial sequence
  Synthetic oligonucleotide
catggttattcaaaaaacttggcag

SEQ ID NO: 725836 - DNA, 25 bp, Artificial sequence
  Synthetic oligonucleotide
ccaatacatggttattcaaaaaact

SEQ ID NO: 725837 - DNA, 25 bp, Artificial sequence
  Synthetic oligonucleotide
gttgtcccaatacatggttattcaa

SEQ ID NO: 725838 - DNA, 25 bp, Artificial sequence
  Synthetic oligonucleotide
tatgcggttgtcccaatacatggtt

SEQ ID NO: 725839 - DNA, 25 bp, Artificial sequence
  Synthetic oligonucleotide
caagtttatgcggttgtcccaatac

SEQ ID NO: 725840 - DNA, 25 bp, Artificial sequence
  Synthetic oligonucleotide
tggtcgaagtgcatgacggcaccga

SEQ ID NO: 725841 - DNA, 25 bp, Artificial sequence
  Synthetic oligonucleotide
accgctagcggccaagtttatgcgg

SEQ ID NO: 725842 - DNA, 25 bp, Artificial sequence
  Synthetic oligonucleotide
aagtgcatgacggcaccgagctgga

SEQ ID NO: 725843 - DNA, 25 bp, Artificial sequence
  Synthetic oligonucleotide
cgccaatgtgcgaaccggcgatgcg

SEQ ID NO: 725844 - DNA, 25 bp, Artificial sequence
  Synthetic oligonucleotide
ccaattatcagggtgcgaccgctag

SEQ ID NO: 725845 - DNA, 25 bp, Artificial sequence
  Synthetic oligonucleotide
ccgggcttccaagttcttatcctgg

SEQ ID NO: 725846 - DNA, 25 bp, Artificial sequence
  Synthetic oligonucleotide
tttctatcaagcccaattatcaggg

SEQ ID NO: 725847 - DNA, 25 bp, Artificial sequence
  Synthetic oligonucleotide
cggttatttctatcaagcccaatta

SEQ ID NO: 725848 - DNA, 25 bp, Artificial sequence
  Synthetic oligonucleotide
gtgcaacggttatttctatcaagcc

SEQ ID NO: 725849 - DNA, 25 bp, Artificial sequence
  Synthetic oligonucleotide
tgaccagtgcaacggttatttctat

SEQ ID NO: 725850 - DNA, 25 bp, Artificial sequence
  Synthetic oligonucleotide
ccaatgtgaccagtgcaacggttat

SEQ ID NO: 725851 - DNA, 25 bp, Artificial sequence
  Synthetic oligonucleotide
aaatcaccaatgtgaccagtgcaac

SEQ ID NO: 725852 - DNA, 25 bp, Artificial sequence
  Synthetic oligonucleotide
ggtacgaaatcaccaatgtgaccag

SEQ ID NO: 725853 - DNA, 25 bp, Artificial sequence
  Synthetic oligonucleotide
gccggtggtacgaaatcaccaatgt

SEQ ID NO: 725854 - DNA, 25 bp, Artificial sequence
  Synthetic oligonucleotide
ctgacggccggtggtacgaaatcac

SEQ ID NO: 725855 - DNA, 25 bp, Artificial sequence
  Synthetic oligonucleotide
gtggccctgacggccggtggtacga

SEQ ID NO: 725856 - DNA, 25 bp, Artificial sequence
  Synthetic oligonucleotide
cgttccgtggccctgacggccggtg

SEQ ID NO: 725857 - DNA, 25 bp, Artificial sequence
  Synthetic oligonucleotide
gcgatgcgttccgtggccctgacgg

SEQ ID NO: 725858 - DNA, 25 bp, Artificial sequence
  Synthetic oligonucleotide
tatcagggtgcgaccgctagcggcc

SEQ ID NO: 725859 - DNA, 25 bp, Artificial sequence
  Synthetic oligonucleotide
tttcgattctctaagacttcccttg

SEQ ID NO: 725860 - DNA, 25 bp, Artificial sequence
  Synthetic oligonucleotide
atatatcgcccagcgacatggggtc

SEQ ID NO: 725861 - DNA, 25 bp, Artificial sequence
  Synthetic oligonucleotide
atagacatatatcgcccagcgacat

SEQ ID NO: 725862 - DNA, 25 bp, Artificial sequence
  Synthetic oligonucleotide
ggccgcatagacatatatcgcccag

SEQ ID NO: 725863 - DNA, 25 bp, Artificial sequence
  Synthetic oligonucleotide
ggagctggccgcatagacatatatc

SEQ ID NO: 725864 - DNA, 25 bp, Artificial sequence
  Synthetic oligonucleotide
attataggagctggccgcatagaca

SEQ ID NO: 725865 - DNA, 25 bp, Artificial sequence
  Synthetic oligonucleotide
gaaccgattataggagctggccgca

SEQ ID NO: 725866 - DNA, 25 bp, Artificial sequence
  Synthetic oligonucleotide
tctggggaaccgattataggagctg

SEQ ID NO: 725867 - DNA, 25 bp, Artificial sequence
  Synthetic oligonucleotide
tagggtatctggggaaccgattata

SEQ ID NO: 725868 - DNA, 25 bp, Artificial sequence
  Synthetic oligonucleotide
agaagattgggttagggtatctggg

SEQ ID NO: 725869 - DNA, 25 bp, Artificial sequence
  Synthetic oligonucleotide
ggcgccagaagattgggttagggta

SEQ ID NO: 725870 - DNA, 25 bp, Artificial sequence
  Synthetic oligonucleotide
tgggcggggcgccagaagattgggt

SEQ ID NO: 725871 - DNA, 25 bp, Artificial sequence
  Synthetic oligonucleotide
gttcttatcctggaattccagctgc

SEQ ID NO: 725872 - DNA, 25 bp, Artificial sequence
  Synthetic oligonucleotide
tttagtgcggaactgggcggggcgc

SEQ ID NO: 725873 - DNA, 25 bp, Artificial sequence
  Synthetic oligonucleotide
gggtcagcctgccgatagctacatt

SEQ ID NO: 725874 - DNA, 25 bp, Artificial sequence
  Synthetic oligonucleotide
tgtcgttttcgattctctaagactt

SEQ ID NO: 725875 - DNA, 25 bp, Artificial sequence
  Synthetic oligonucleotide
gggaagtgtcgttttcgattctcta

SEQ ID NO: 725876 - DNA, 25 bp, Artificial sequence
  Synthetic oligonucleotide
ctcggcgggaagtgtcgttttcgat

SEQ ID NO: 725877 - DNA, 25 bp, Artificial sequence
  Synthetic oligonucleotide
cgtgttcgaaactcggcgggaagtg

SEQ ID NO: 725878 - DNA, 25 bp, Artificial sequence
  Synthetic oligonucleotide
gatatggacttcgtgttcgaaactc

SEQ ID NO: 725879 - DNA, 25 bp, Artificial sequence
  Synthetic oligonucleotide
tgagaggatatggacttcgtgttcg

SEQ ID NO: 725880 - DNA, 25 bp, Artificial sequence
  Synthetic oligonucleotide
ctttgctgagaggatatggacttcg

SEQ ID NO: 725881 - DNA, 25 bp, Artificial sequence
  Synthetic oligonucleotide
cattgcctttgctgagaggatatgg

SEQ ID NO: 725882 - DNA, 25 bp, Artificial sequence
  Synthetic oligonucleotide
cctacgcattgcctttgctgagagg

SEQ ID NO: 725883 - DNA, 25 bp, Artificial sequence
  Synthetic oligonucleotide
tttatgcctacgcattgcctttgct

SEQ ID NO: 725884 - DNA, 25 bp, Artificial sequence
  Synthetic oligonucleotide
ttagagtttatgcctacgcattgcc

SEQ ID NO: 725885 - DNA, 25 bp, Artificial sequence
  Synthetic oligonucleotide
taagaattagagtttatgcctacgc

SEQ ID NO: 725886 - DNA, 25 bp, Artificial sequence
  Synthetic oligonucleotide
gcggaactgggcggggcgccagaag

SEQ ID NO: 725887 - DNA, 25 bp, Artificial sequence
  Synthetic oligonucleotide
ctggtggtacggctaatgcaattat

SEQ ID NO: 725888 - DNA, 25 bp, Artificial sequence
  Synthetic oligonucleotide
tcagtcaaatgcaatgtccaataac

SEQ ID NO: 725889 - DNA, 25 bp, Artificial sequence
  Synthetic oligonucleotide
catataccgggcttccaagttctta

SEQ ID NO: 725890 - DNA, 25 bp, Artificial sequence
  Synthetic oligonucleotide
agcatgcatataccgggcttccaag

SEQ ID NO: 725891 - DNA, 25 bp, Artificial sequence
  Synthetic oligonucleotide
tatgcagcatgcatataccgggctt

SEQ ID NO: 725892 - DNA, 25 bp, Artificial sequence
  Synthetic oligonucleotide
aaggcttatgcagcatgcatatacc

SEQ ID NO: 725893 - DNA, 25 bp, Artificial sequence
  Synthetic oligonucleotide
agtgccaaggcttatgcagcatgca

SEQ ID NO: 725894 - DNA, 25 bp, Artificial sequence
  Synthetic oligonucleotide
ggagggagtgccaaggcttatgcag

SEQ ID NO: 725895 - DNA, 25 bp, Artificial sequence
  Synthetic oligonucleotide
cactgaggagggagtgccaaggctt

SEQ ID NO: 725896 - DNA, 25 bp, Artificial sequence
  Synthetic oligonucleotide
gggtttcactgaggagggagtgcca

SEQ ID NO: 725897 - DNA, 25 bp, Artificial sequence
  Synthetic oligonucleotide
tacgctggggtttcactgaggaggg

SEQ ID NO: 725898 - DNA, 25 bp, Artificial sequence
  Synthetic oligonucleotide
tttatatacgctggggtttcactga

SEQ ID NO: 725899 - DNA, 25 bp, Artificial sequence
  Synthetic oligonucleotide
caattatttatatacgctggggttt

SEQ ID NO: 725900 - DNA, 25 bp, Artificial sequence
  Synthetic oligonucleotide
cgcccagcgacatggggtcagcctg

SEQ ID NO: 725901 - DNA, 25 bp, Artificial sequence
  Synthetic oligonucleotide
gtacggctaatgcaattatttatat

SEQ ID NO: 725902 - DNA, 25 bp, Artificial sequence
  Synthetic oligonucleotide
cgacatggggtcagcctgccgatag

SEQ ID NO: 725903 - DNA, 25 bp, Artificial sequence
  Synthetic oligonucleotide
cggtatctggtggtacggctaatgc

SEQ ID NO: 725904 - DNA, 25 bp, Artificial sequence
  Synthetic oligonucleotide
agagtggcggtatctggtggtacgg

SEQ ID NO: 725905 - DNA, 25 bp, Artificial sequence
  Synthetic oligonucleotide
tttggcagagtggcggtatctggtg

SEQ ID NO: 725906 - DNA, 25 bp, Artificial sequence
  Synthetic oligonucleotide
tggaatttggcagagtggcggtatc

SEQ ID NO: 725907 - DNA, 25 bp, Artificial sequence
  Synthetic oligonucleotide
tgacgtggaatttggcagagtggcg

SEQ ID NO: 725908 - DNA, 25 bp, Artificial sequence
  Synthetic oligonucleotide
ggcacttgacgtggaatttggcaga

SEQ ID NO: 725909 - DNA, 25 bp, Artificial sequence
  Synthetic oligonucleotide
aggcatggcacttgacgtggaattt

SEQ ID NO: 725910 - DNA, 25 bp, Artificial sequence
  Synthetic oligonucleotide
tgcagtaggcatggcacttgacgtg

SEQ ID NO: 725911 - DNA, 25 bp, Artificial sequence
  Synthetic oligonucleotide
ctacattgcagtaggcatggcactt

SEQ ID NO: 725912 - DNA, 25 bp, Artificial sequence
  Synthetic oligonucleotide
cgatagctacattgcagtaggcatg

SEQ ID NO: 725913 - DNA, 25 bp, Artificial sequence
  Synthetic oligonucleotide
gcctgccgatagctacattgcagta

SEQ ID NO: 725914 - DNA, 25 bp, Artificial sequence
  Synthetic oligonucleotide
ttccaagttcttatcctggaattcc

SEQ ID NO: 725915 - DNA, 25 bp, Artificial sequence
  Synthetic oligonucleotide
ctaatgcaattatttatatacgctg

SEQ ID NO: 725916 - DNA, 25 bp, Artificial sequence
  Synthetic oligonucleotide
ggtggatatcgggggcttgcagaag

SEQ ID NO: 725917 - DNA, 25 bp, Artificial sequence
  Synthetic oligonucleotide
aatgtccaataacggtatgccgata

SEQ ID NO: 725918 - DNA, 25 bp, Artificial sequence
  Synthetic oligonucleotide
gtctacgcgaagaacgacatggtgc

SEQ ID NO: 725919 - DNA, 25 bp, Artificial sequence
  Synthetic oligonucleotide
gccaaggtctacgcgaagaacgaca

SEQ ID NO: 725920 - DNA, 25 bp, Artificial sequence
  Synthetic oligonucleotide
gacccggccaaggtctacgcgaaga

SEQ ID NO: 725921 - DNA, 25 bp, Artificial sequence
  Synthetic oligonucleotide
ctgtacgacccggccaaggtctacg

SEQ ID NO: 725922 - DNA, 25 bp, Artificial sequence
  Synthetic oligonucleotide
gttctgctgtacgacccggccaagg

SEQ ID NO: 725923 - DNA, 25 bp, Artificial sequence
  Synthetic oligonucleotide
gccgacgttctgctgtacgacccgg

SEQ ID NO: 725924 - DNA, 25 bp, Artificial sequence
  Synthetic oligonucleotide
acctcgccgacgttctgctgtacga

SEQ ID NO: 725925 - DNA, 25 bp, Artificial sequence
  Synthetic oligonucleotide
tcggcgacctcgccgacgttctgct

SEQ ID NO: 725926 - DNA, 25 bp, Artificial sequence
  Synthetic oligonucleotide
agcaggtcggcgacctcgccgacgt

SEQ ID NO: 725927 - DNA, 25 bp, Artificial sequence
  Synthetic oligonucleotide
tgcagaagcaggtcggcgacctcgc

SEQ ID NO: 725928 - DNA, 25 bp, Artificial sequence
  Synthetic oligonucleotide
aacgacatggtgcgacaggggcagc

SEQ ID NO: 725929 - DNA, 25 bp, Artificial sequence
  Synthetic oligonucleotide
tatcgggggcttgcagaagcaggtc

SEQ ID NO: 725930 - DNA, 25 bp, Artificial sequence
  Synthetic oligonucleotide
catggtgcgacaggggcagcggttg

SEQ ID NO: 725931 - DNA, 25 bp, Artificial sequence
  Synthetic oligonucleotide
gatgcaggtggatatcgggggcttg

SEQ ID NO: 725932 - DNA, 25 bp, Artificial sequence
  Synthetic oligonucleotide
cgaacggatgcaggtggatatcggg

SEQ ID NO: 725933 - DNA, 25 bp, Artificial sequence
  Synthetic oligonucleotide
gatatcgaacggatgcaggtggata

SEQ ID NO: 725934 - DNA, 25 bp, Artificial sequence
  Synthetic oligonucleotide
ttctccgatatcgaacggatgcagg

SEQ ID NO: 725935 - DNA, 25 bp, Artificial sequence
  Synthetic oligonucleotide
cagttcttctccgatatcgaacgga

SEQ ID NO: 725936 - DNA, 25 bp, Artificial sequence
  Synthetic oligonucleotide
ggccagcagttcttctccgatatcg

SEQ ID NO: 725937 - DNA, 25 bp, Artificial sequence
  Synthetic oligonucleotide
gcgctgggccagcagttcttctccg

SEQ ID NO: 725938 - DNA, 25 bp, Artificial sequence
  Synthetic oligonucleotide
gagtcggcgctgggccagcagttct

SEQ ID NO: 725939 - DNA, 25 bp, Artificial sequence
  Synthetic oligonucleotide
tacgtcgagtcggcgctgggccagc

SEQ ID NO: 725940 - DNA, 25 bp, Artificial sequence
  Synthetic oligonucleotide
caggagtacgtcgagtcggcgctgg

SEQ ID NO: 725941 - DNA, 25 bp, Artificial sequence
  Synthetic oligonucleotide
atcacccaggagtacgtcgagtcgg

SEQ ID NO: 725942 - DNA, 25 bp, Artificial sequence
  Synthetic oligonucleotide
cagttgatcacccaggagtacgtcg

SEQ ID NO: 725943 - DNA, 25 bp, Artificial sequence
  Synthetic oligonucleotide
gggcttgcagaagcaggtcggcgac

SEQ ID NO: 725944 - DNA, 25 bp, Artificial sequence
  Synthetic oligonucleotide
tggtccgatatcggccagtcgctgg

SEQ ID NO: 725945 - DNA, 25 bp, Artificial sequence
  Synthetic oligonucleotide
gaactcgacggcagccttaccgccc

SEQ ID NO: 725946 - DNA, 25 bp, Artificial sequence
  Synthetic oligonucleotide
atcagcgaactcgacggcagcctta

SEQ ID NO: 725947 - DNA, 25 bp, Artificial sequence
  Synthetic oligonucleotide
gctgaaatcagcgaactcgacggca

SEQ ID NO: 725948 - DNA, 25 bp, Artificial sequence
  Synthetic oligonucleotide
cataccgctgaaatcagcgaactcg

SEQ ID NO: 725949 - DNA, 25 bp, Artificial sequence
  Synthetic oligonucleotide
gcgagccataccgctgaaatcagcg

SEQ ID NO: 725950 - DNA, 25 bp, Artificial sequence
  Synthetic oligonucleotide
caggtggcgagccataccgctgaaa

SEQ ID NO: 725951 - DNA, 25 bp, Artificial sequence
  Synthetic oligonucleotide
ggcgcagcaggtggcgagccatacc

SEQ ID NO: 725952 - DNA, 25 bp, Artificial sequence
  Synthetic oligonucleotide
cgggctggcgcagcaggtggcgagc

SEQ ID NO: 725953 - DNA, 25 bp, Artificial sequence
  Synthetic oligonucleotide
cgccaacgggctggcgcagcaggtg

SEQ ID NO: 725954 - DNA, 25 bp, Artificial sequence
  Synthetic oligonucleotide
gaaaccgccaacgggctggcgcagc

SEQ ID NO: 725955 - DNA, 25 bp, Artificial sequence
  Synthetic oligonucleotide
tcgctggaaaccgccaacgggctgg

SEQ ID NO: 725956 - DNA, 25 bp, Artificial sequence
  Synthetic oligonucleotide
gcgaagaacgacatggtgcgacagg

SEQ ID NO: 725957 - DNA, 25 bp, Artificial sequence
  Synthetic oligonucleotide
gatatcggccagtcgctggaaaccg

SEQ ID NO: 725958 - DNA, 25 bp, Artificial sequence
  Synthetic oligonucleotide
cgacgccagcgaatacaaccagttg

SEQ ID NO: 725959 - DNA, 25 bp, Artificial sequence
  Synthetic oligonucleotide
gcctactggtccgatatcggccagt

SEQ ID NO: 725960 - DNA, 25 bp, Artificial sequence
  Synthetic oligonucleotide
aacgcggcctactggtccgatatcg

SEQ ID NO: 725961 - DNA, 25 bp, Artificial sequence
  Synthetic oligonucleotide
ccgccgaacgcggcctactggtccg

SEQ ID NO: 725962 - DNA, 25 bp, Artificial sequence
  Synthetic oligonucleotide
acggcgccgccgaacgcggcctact

SEQ ID NO: 725963 - DNA, 25 bp, Artificial sequence
  Synthetic oligonucleotide
gcgaagacggcgccgccgaacgcgg

SEQ ID NO: 725964 - DNA, 25 bp, Artificial sequence
  Synthetic oligonucleotide
tgtgccggcgaagacggcgccgccg

SEQ ID NO: 725965 - DNA, 25 bp, Artificial sequence
  Synthetic oligonucleotide
gaaggctgtgccggcgaagacggcg

SEQ ID NO: 725966 - DNA, 25 bp, Artificial sequence
  Synthetic oligonucleotide
ggcactgaaggctgtgccggcgaag

SEQ ID NO: 725967 - DNA, 25 bp, Artificial sequence
  Synthetic oligonucleotide
taccaggcactgaaggctgtgccgg

SEQ ID NO: 725968 - DNA, 25 bp, Artificial sequence
  Synthetic oligonucleotide
cggttgtaccaggcactgaaggctg

SEQ ID NO: 725969 - DNA, 25 bp, Artificial sequence
  Synthetic oligonucleotide
gggcagcggttgtaccaggcactga

SEQ ID NO: 725970 - DNA, 25 bp, Artificial sequence
  Synthetic oligonucleotide
gcgacaggggcagcggttgtaccag

SEQ ID NO: 725971 - DNA, 25 bp, Artificial sequence
  Synthetic oligonucleotide
ggccagtcgctggaaaccgccaacg

SEQ ID NO: 725972 - DNA, 25 bp, Artificial sequence
  Synthetic oligonucleotide
ccctggcgcatcggcctggagtggg

SEQ ID NO: 725973 - DNA, 25 bp, Artificial sequence
  Synthetic oligonucleotide
acgcccggcggcagcgaggagaccg

SEQ ID NO: 725974 - DNA, 25 bp, Artificial sequence
  Synthetic oligonucleotide
tccgccacgcccggcggcagcgagg

SEQ ID NO: 725975 - DNA, 25 bp, Artificial sequence
  Synthetic oligonucleotide
cagcagtccgccacgcccggcggca

SEQ ID NO: 725976 - DNA, 25 bp, Artificial sequence
  Synthetic oligonucleotide
gagatccagcagtccgccacgcccg

SEQ ID NO: 725977 - DNA, 25 bp, Artificial sequence
  Synthetic oligonucleotide
tacaccgagatccagcagtccgcca

SEQ ID NO: 725978 - DNA, 25 bp, Artificial sequence
  Synthetic oligonucleotide
accgcctacaccgagatccagcagt

SEQ ID NO: 725979 - DNA, 25 bp, Artificial sequence
  Synthetic oligonucleotide
gcggacaccgcctacaccgagatcc

SEQ ID NO: 725980 - DNA, 25 bp, Artificial sequence
  Synthetic oligonucleotide
ggcgcagcggacaccgcctacaccg

SEQ ID NO: 725981 - DNA, 25 bp, Artificial sequence
  Synthetic oligonucleotide
accagcggcgcagcggacaccgcct

SEQ ID NO: 725982 - DNA, 25 bp, Artificial sequence
  Synthetic oligonucleotide
tcccgaccagcggcgcagcggacac

SEQ ID NO: 725983 - DNA, 25 bp, Artificial sequence
  Synthetic oligonucleotide
gggggttcccgaccagcggcgcagc

SEQ ID NO: 725984 - DNA, 25 bp, Artificial sequence
  Synthetic oligonucleotide
atacaaccagttgatcacccaggag

SEQ ID NO: 725985 - DNA, 25 bp, Artificial sequence
  Synthetic oligonucleotide
cgcatcggcctggagtgggggttcc

SEQ ID NO: 725986 - DNA, 25 bp, Artificial sequence
  Synthetic oligonucleotide
gagaccgcacgggcgctgggcctgt

SEQ ID NO: 725987 - DNA, 25 bp, Artificial sequence
  Synthetic oligonucleotide
ccggcccctggcgcatcggcctgga

SEQ ID NO: 725988 - DNA, 25 bp, Artificial sequence
  Synthetic oligonucleotide
cgtggccggcccctggcgcatcggc

SEQ ID NO: 725989 - DNA, 25 bp, Artificial sequence
  Synthetic oligonucleotide
tgcgctgcgtggccggcccctggcg

SEQ ID NO: 725990 - DNA, 25 bp, Artificial sequence
  Synthetic oligonucleotide
cctacctgcgctgcgtggccggccc

SEQ ID NO: 725991 - DNA, 25 bp, Artificial sequence
  Synthetic oligonucleotide
gctggcctacctgcgctgcgtggcc

SEQ ID NO: 725992 - DNA, 25 bp, Artificial sequence
  Synthetic oligonucleotide
ccggcgctggcctacctgcgctgcg

SEQ ID NO: 725993 - DNA, 25 bp, Artificial sequence
  Synthetic oligonucleotide
ccgccgccggcgctggcctacctgc

SEQ ID NO: 725994 - DNA, 25 bp, Artificial sequence
  Synthetic oligonucleotide
accacgccgccgccggcgctggcct

SEQ ID NO: 725995 - DNA, 25 bp, Artificial sequence
  Synthetic oligonucleotide
gggcaagaccacgccgccgccggcg

SEQ ID NO: 725996 - DNA, 25 bp, Artificial sequence
  Synthetic oligonucleotide
tcttgagggcaagaccacgccgccg

SEQ ID NO: 725997 - DNA, 25 bp, Artificial sequence
  Synthetic oligonucleotide
gaccgctcttgagggcaagaccacg

SEQ ID NO: 725998 - DNA, 25 bp, Artificial sequence
  Synthetic oligonucleotide
tgtggagaccgctcttgagggcaag

SEQ ID NO: 725999 - DNA, 25 bp, Artificial sequence
  Synthetic oligonucleotide
ctggagtgggggttcccgaccagcg

SEQ ID NO: 726000 - DNA, 25 bp, Artificial sequence
  Synthetic oligonucleotide
gaacggctggcgttccgcggtcgct

SEQ ID NO: 726001 - DNA, 25 bp, Artificial sequence
  Synthetic oligonucleotide
accgcccaggcatcgcgccttggcg

SEQ ID NO: 726002 - DNA, 25 bp, Artificial sequence
  Synthetic oligonucleotide
ctccagcgacgccagcgaatacaac

SEQ ID NO: 726003 - DNA, 25 bp, Artificial sequence
  Synthetic oligonucleotide
caccagctccagcgacgccagcgaa

SEQ ID NO: 726004 - DNA, 25 bp, Artificial sequence
  Synthetic oligonucleotide
tcaccggcaccagctccagcgacgc

SEQ ID NO: 726005 - DNA, 25 bp, Artificial sequence
  Synthetic oligonucleotide
actgggtcaccggcaccagctccag

SEQ ID NO: 726006 - DNA, 25 bp, Artificial sequence
  Synthetic oligonucleotide
ggtcgaactgggtcaccggcaccag

SEQ ID NO: 726007 - DNA, 25 bp, Artificial sequence
  Synthetic oligonucleotide
gcgcctggtcgaactgggtcaccgg

SEQ ID NO: 726008 - DNA, 25 bp, Artificial sequence
  Synthetic oligonucleotide
acgtcggcgcctggtcgaactgggt

SEQ ID NO: 726009 - DNA, 25 bp, Artificial sequence
  Synthetic oligonucleotide
gcggcaacgtcggcgcctggtcgaa

SEQ ID NO: 726010 - DNA, 25 bp, Artificial sequence
  Synthetic oligonucleotide
accgtagcggcaacgtcggcgcctg

SEQ ID NO: 726011 - DNA, 25 bp, Artificial sequence
  Synthetic oligonucleotide
tgatcgaccgtagcggcaacgtcgg

SEQ ID NO: 726012 - DNA, 25 bp, Artificial sequence
  Synthetic oligonucleotide
gtcgcttgatcgaccgtagcggcaa

SEQ ID NO: 726013 - DNA, 25 bp, Artificial sequence
  Synthetic oligonucleotide
ggcggcagcgaggagaccgcacggg

SEQ ID NO: 726014 - DNA, 25 bp, Artificial sequence
  Synthetic oligonucleotide
tggcgttccgcggtcgcttgatcga

SEQ ID NO: 726015 - DNA, 25 bp, Artificial sequence
  Synthetic oligonucleotide
agcgaggagaccgcacgggcgctgg

SEQ ID NO: 726016 - DNA, 25 bp, Artificial sequence
  Synthetic oligonucleotide
gccggcgaacggctggcgttccgcg

SEQ ID NO: 726017 - DNA, 25 bp, Artificial sequence
  Synthetic oligonucleotide
ataccggccggcgaacggctggcgt

SEQ ID NO: 726018 - DNA, 25 bp, Artificial sequence
  Synthetic oligonucleotide
tcgccgataccggccggcgaacggc

SEQ ID NO: 726019 - DNA, 25 bp, Artificial sequence
  Synthetic oligonucleotide
ctggtatcgccgataccggccggcg

SEQ ID NO: 726020 - DNA, 25 bp, Artificial sequence
  Synthetic oligonucleotide
acccacctggtatcgccgataccgg

SEQ ID NO: 726021 - DNA, 25 bp, Artificial sequence
  Synthetic oligonucleotide
ggcaatacccacctggtatcgccga

SEQ ID NO: 726022 - DNA, 25 bp, Artificial sequence
  Synthetic oligonucleotide
tacccaggcaatacccacctggtat

SEQ ID NO: 726023 - DNA, 25 bp, Artificial sequence
  Synthetic oligonucleotide
ttcgcctacccaggcaatacccacc

SEQ ID NO: 726024 - DNA, 25 bp, Artificial sequence
  Synthetic oligonucleotide
ggcctgttcgcctacccaggcaata

SEQ ID NO: 726025 - DNA, 25 bp, Artificial sequence
  Synthetic oligonucleotide
cgctgggcctgttcgcctacccagg

SEQ ID NO: 726026 - DNA, 25 bp, Artificial sequence
  Synthetic oligonucleotide
cacgggcgctgggcctgttcgccta

SEQ ID NO: 726027 - DNA, 25 bp, Artificial sequence
  Synthetic oligonucleotide
cagcgaatacaaccagttgatcacc

SEQ ID NO: 726028 - DNA, 25 bp, Artificial sequence
  Synthetic oligonucleotide
tccgcggtcgcttgatcgaccgtag

SEQ ID NO: 726029 - DNA, 25 bp, Artificial sequence
  Synthetic oligonucleotide
tcaaggcgatgtacagcgtgaagct

SEQ ID NO: 726030 - DNA, 25 bp, Artificial sequence
  Synthetic oligonucleotide
gacagtgggacaagtgtgtcgacca

SEQ ID NO: 726031 - DNA, 25 bp, Artificial sequence
  Synthetic oligonucleotide
gggttcgacagtgggacaagtgtgt

SEQ ID NO: 726032 - DNA, 25 bp, Artificial sequence
  Synthetic oligonucleotide
caactggggttcgacagtgggacaa

SEQ ID NO: 726033 - DNA, 25 bp, Artificial sequence
  Synthetic oligonucleotide
gatggcaactggggttcgacagtgg

SEQ ID NO: 726034 - DNA, 25 bp, Artificial sequence
  Synthetic oligonucleotide
cggcgggatggcaactggggttcga

SEQ ID NO: 726035 - DNA, 25 bp, Artificial sequence
  Synthetic oligonucleotide
agtatgcggcgggatggcaactggg

SEQ ID NO: 726036 - DNA, 25 bp, Artificial sequence
  Synthetic oligonucleotide
acaaaagtatgcggcgggatggcaa

SEQ ID NO: 726037 - DNA, 25 bp, Artificial sequence
  Synthetic oligonucleotide
caacggacaaaagtatgcggcggga

SEQ ID NO: 726038 - DNA, 25 bp, Artificial sequence
  Synthetic oligonucleotide
gcatgccaacggacaaaagtatgcg

SEQ ID NO: 726039 - DNA, 25 bp, Artificial sequence
  Synthetic oligonucleotide
ccaggcgcatgccaacggacaaaag

SEQ ID NO: 726040 - DNA, 25 bp, Artificial sequence
  Synthetic oligonucleotide
gaagctccaggcgcatgccaacgga

SEQ ID NO: 726041 - DNA, 25 bp, Artificial sequence
  Synthetic oligonucleotide
gtgcaggcgcgtaccgacaccaaca

SEQ ID NO: 726042 - DNA, 25 bp, Artificial sequence
  Synthetic oligonucleotide
cgatgtacagcgtgaagctccaggc

SEQ ID NO: 726043 - DNA, 25 bp, Artificial sequence
  Synthetic oligonucleotide
tcgaccatggcgtttcaggcggatc

SEQ ID NO: 726044 - DNA, 25 bp, Artificial sequence
  Synthetic oligonucleotide
gcaacgtcaaggcgatgtacagcgt

SEQ ID NO: 726045 - DNA, 25 bp, Artificial sequence
  Synthetic oligonucleotide
ctggatggcaacgtcaaggcgatgt

SEQ ID NO: 726046 - DNA, 25 bp, Artificial sequence
  Synthetic oligonucleotide
acctcgctggatggcaacgtcaagg

SEQ ID NO: 726047 - DNA, 25 bp, Artificial sequence
  Synthetic oligonucleotide
gctgtcacctcgctggatggcaacg

SEQ ID NO: 726048 - DNA, 25 bp, Artificial sequence
  Synthetic oligonucleotide
tcccaggctgtcacctcgctggatg

SEQ ID NO: 726049 - DNA, 25 bp, Artificial sequence
  Synthetic oligonucleotide
gaccacctcccaggctgtcacctcg

SEQ ID NO: 726050 - DNA, 25 bp, Artificial sequence
  Synthetic oligonucleotide
atccagaccacctcccaggctgtca

SEQ ID NO: 726051 - DNA, 25 bp, Artificial sequence
  Synthetic oligonucleotide
gcggcgatccagaccacctcccagg

SEQ ID NO: 726052 - DNA, 25 bp, Artificial sequence
  Synthetic oligonucleotide
aacagcgcggcgatccagaccacct

SEQ ID NO: 726053 - DNA, 25 bp, Artificial sequence
  Synthetic oligonucleotide
gacaccaacagcgcggcgatccaga

SEQ ID NO: 726054 - DNA, 25 bp, Artificial sequence
  Synthetic oligonucleotide
gtaccgacaccaacagcgcggcgat

SEQ ID NO: 726055 - DNA, 25 bp, Artificial sequence
  Synthetic oligonucleotide
gacggcagccttaccgcccaggcat

SEQ ID NO: 726056 - DNA, 25 bp, Artificial sequence
  Synthetic oligonucleotide
acagcgtgaagctccaggcgcatgc

SEQ ID NO: 726057 - DNA, 25 bp, Artificial sequence
  Synthetic oligonucleotide
tccattgttaatggacagatgttta

SEQ ID NO: 726058 - DNA, 25 bp, Artificial sequence
  Synthetic oligonucleotide
gaccaattccgcgacatcaacaacc

SEQ ID NO: 726059 - DNA, 25 bp, Artificial sequence
  Synthetic oligonucleotide
tgtcattcagtcaaatgcaatgtcc

SEQ ID NO: 726060 - DNA, 25 bp, Artificial sequence
  Synthetic oligonucleotide
tggaaatgtcattcagtcaaatgca

SEQ ID NO: 726061 - DNA, 25 bp, Artificial sequence
  Synthetic oligonucleotide
gaaaattggaaatgtcattcagtca

SEQ ID NO: 726062 - DNA, 25 bp, Artificial sequence
  Synthetic oligonucleotide
taacgcgaaaattggaaatgtcatt

SEQ ID NO: 726063 - DNA, 25 bp, Artificial sequence
  Synthetic oligonucleotide
gatagataacgcgaaaattggaaat

SEQ ID NO: 726064 - DNA, 25 bp, Artificial sequence
  Synthetic oligonucleotide
cggagcgatagataacgcgaaaatt

SEQ ID NO: 726065 - DNA, 25 bp, Artificial sequence
  Synthetic oligonucleotide
tcaggacggagcgatagataacgcg

SEQ ID NO: 726066 - DNA, 25 bp, Artificial sequence
  Synthetic oligonucleotide
cctgattcaggacggagcgatagat

SEQ ID NO: 726067 - DNA, 25 bp, Artificial sequence
  Synthetic oligonucleotide
aacgccctgattcaggacggagcga

SEQ ID NO: 726068 - DNA, 25 bp, Artificial sequence
  Synthetic oligonucleotide
atcaagaacgccctgattcaggacg

SEQ ID NO: 726069 - DNA, 25 bp, Artificial sequence
  Synthetic oligonucleotide
atgtttatcaagaacgccctgattc

SEQ ID NO: 726070 - DNA, 25 bp, Artificial sequence
  Synthetic oligonucleotide
gggacaagtgtgtcgaccatggcgt

SEQ ID NO: 726071 - DNA, 25 bp, Artificial sequence
  Synthetic oligonucleotide
gttaatggacagatgtttatcaaga

SEQ ID NO: 726072 - DNA, 25 bp, Artificial sequence
  Synthetic oligonucleotide
agtgtgtcgaccatggcgtttcagg

SEQ ID NO: 726073 - DNA, 25 bp, Artificial sequence
  Synthetic oligonucleotide
ccggtttccattgttaatggacaga

SEQ ID NO: 726074 - DNA, 25 bp, Artificial sequence
  Synthetic oligonucleotide
gtagcgccggtttccattgttaatg

SEQ ID NO: 726075 - DNA, 25 bp, Artificial sequence
  Synthetic oligonucleotide
acggcggtagcgccggtttccattg

SEQ ID NO: 726076 - DNA, 25 bp, Artificial sequence
  Synthetic oligonucleotide
cagcgggacggcggtagcgccggtt

SEQ ID NO: 726077 - DNA, 25 bp, Artificial sequence
  Synthetic oligonucleotide
cagctccagcgggacggcggtagcg

SEQ ID NO: 726078 - DNA, 25 bp, Artificial sequence
  Synthetic oligonucleotide
gttcgacagctccagcgggacggcg

SEQ ID NO: 726079 - DNA, 25 bp, Artificial sequence
  Synthetic oligonucleotide
tatctggttcgacagctccagcggg

SEQ ID NO: 726080 - DNA, 25 bp, Artificial sequence
  Synthetic oligonucleotide
tcggtttatctggttcgacagctcc

SEQ ID NO: 726081 - DNA, 25 bp, Artificial sequence
  Synthetic oligonucleotide
ggcggatcggtttatctggttcgac

SEQ ID NO: 726082 - DNA, 25 bp, Artificial sequence
  Synthetic oligonucleotide
gtttcaggcggatcggtttatctgg

SEQ ID NO: 726083 - DNA, 25 bp, Artificial sequence
  Synthetic oligonucleotide
catggcgtttcaggcggatcggttt

SEQ ID NO: 726084 - DNA, 25 bp, Artificial sequence
  Synthetic oligonucleotide
gacaccgtgcaggcgcgtaccgaca

SEQ ID NO: 726085 - DNA, 25 bp, Artificial sequence
  Synthetic oligonucleotide
ggacagatgtttatcaagaacgccc

SEQ ID NO: 726086 - DNA, 25 bp, Artificial sequence
  Synthetic oligonucleotide
tggccgatgccctgcgcggctggaa

SEQ ID NO: 726087 - DNA, 25 bp, Artificial sequence
  Synthetic oligonucleotide
aggcgcgcaccgccgatgccgaagg

SEQ ID NO: 726088 - DNA, 25 bp, Artificial sequence
  Synthetic oligonucleotide
tactggaggcgcgcaccgccgatgc

SEQ ID NO: 726089 - DNA, 25 bp, Artificial sequence
  Synthetic oligonucleotide
cgacgctactggaggcgcgcaccgc

SEQ ID NO: 726090 - DNA, 25 bp, Artificial sequence
  Synthetic oligonucleotide
ctcgcacgacgctactggaggcgcg

SEQ ID NO: 726091 - DNA, 25 bp, Artificial sequence
  Synthetic oligonucleotide
aggccactcgcacgacgctactgga

SEQ ID NO: 726092 - DNA, 25 bp, Artificial sequence
  Synthetic oligonucleotide
aggcccaggccactcgcacgacgct

SEQ ID NO: 726093 - DNA, 25 bp, Artificial sequence
  Synthetic oligonucleotide
gaaaacgaggcccaggccactcgca

SEQ ID NO: 726094 - DNA, 25 bp, Artificial sequence
  Synthetic oligonucleotide
gccaccgaaaacgaggcccaggcca

SEQ ID NO: 726095 - DNA, 25 bp, Artificial sequence
  Synthetic oligonucleotide
gttgcccgggcagcccaggaggaaa

SEQ ID NO: 726096 - DNA, 25 bp, Artificial sequence
  Synthetic oligonucleotide
agaccgttgcccgggcagcccagga

SEQ ID NO: 726097 - DNA, 25 bp, Artificial sequence
  Synthetic oligonucleotide
ctggaagaccgttgcccgggcagcc

SEQ ID NO: 726098 - DNA, 25 bp, Artificial sequence
  Synthetic oligonucleotide
ggcgcgtaccgacaccaacagcgcg

SEQ ID NO: 726099 - DNA, 25 bp, Artificial sequence
  Synthetic oligonucleotide
atgccctgcgcggctggaagaccgt

SEQ ID NO: 726100 - DNA, 25 bp, Artificial sequence
  Synthetic oligonucleotide
gccgaagggcgtatcgccacggtgg

SEQ ID NO: 726101 - DNA, 25 bp, Artificial sequence
  Synthetic oligonucleotide
gcgccatggccgatgccctgcgcgg

SEQ ID NO: 726102 - DNA, 25 bp, Artificial sequence
  Synthetic oligonucleotide
gcaatggcgccatggccgatgccct

SEQ ID NO: 726103 - DNA, 25 bp, Artificial sequence
  Synthetic oligonucleotide
atgacggcaatggcgccatggccga

SEQ ID NO: 726104 - DNA, 25 bp, Artificial sequence
  Synthetic oligonucleotide
acgcggatgacggcaatggcgccat

SEQ ID NO: 726105 - DNA, 25 bp, Artificial sequence
  Synthetic oligonucleotide
gtgacgacgcggatgacggcaatgg

SEQ ID NO: 726106 - DNA, 25 bp, Artificial sequence
  Synthetic oligonucleotide
cgacccgtgacgacgcggatgacgg

SEQ ID NO: 726107 - DNA, 25 bp, Artificial sequence
  Synthetic oligonucleotide
aggcggcgacccgtgacgacgcgga

SEQ ID NO: 726108 - DNA, 25 bp, Artificial sequence
  Synthetic oligonucleotide
gtactgcaggcggcgacccgtgacg

SEQ ID NO: 726109 - DNA, 25 bp, Artificial sequence
  Synthetic oligonucleotide
cttggcgtactgcaggcggcgaccc

SEQ ID NO: 726110 - DNA, 25 bp, Artificial sequence
  Synthetic oligonucleotide
tcgcgccttggcgtactgcaggcgg

SEQ ID NO: 726111 - DNA, 25 bp, Artificial sequence
  Synthetic oligonucleotide
caggcatcgcgccttggcgtactgc

SEQ ID NO: 726112 - DNA, 25 bp, Artificial sequence
  Synthetic oligonucleotide
aaatgcaatgtccaataacggtatg

SEQ ID NO: 726113 - DNA, 25 bp, Artificial sequence
  Synthetic oligonucleotide
tgcgcggctggaagaccgttgcccg

SEQ ID NO: 726114 - DNA, 25 bp, Artificial sequence
  Synthetic oligonucleotide
agctctcggcctcgatcggtggcac

SEQ ID NO: 726115 - DNA, 25 bp, Artificial sequence
  Synthetic oligonucleotide
cggatcgacaccgtgcaggcgcgta

SEQ ID NO: 726116 - DNA, 25 bp, Artificial sequence
  Synthetic oligonucleotide
cgcacagcggatcgacaccgtgcag

SEQ ID NO: 726117 - DNA, 25 bp, Artificial sequence
  Synthetic oligonucleotide
cgccctcgcacagcggatcgacacc

SEQ ID NO: 726118 - DNA, 25 bp, Artificial sequence
  Synthetic oligonucleotide
cgacagcgccctcgcacagcggatc

SEQ ID NO: 726119 - DNA, 25 bp, Artificial sequence
  Synthetic oligonucleotide
ccaacgccgacagcgccctcgcaca

SEQ ID NO: 726120 - DNA, 25 bp, Artificial sequence
  Synthetic oligonucleotide
cccgcgccaacgccgacagcgccct

SEQ ID NO: 726121 - DNA, 25 bp, Artificial sequence
  Synthetic oligonucleotide
agaccgcccgcgccaacgccgacag

SEQ ID NO: 726122 - DNA, 25 bp, Artificial sequence
  Synthetic oligonucleotide
gcgaacagaccgcccgcgccaacgc

SEQ ID NO: 726123 - DNA, 25 bp, Artificial sequence
  Synthetic oligonucleotide
tgcagagcgaacagaccgcccgcgc

SEQ ID NO: 726124 - DNA, 25 bp, Artificial sequence
  Synthetic oligonucleotide
ccagcctgcagagcgaacagaccgc

SEQ ID NO: 726125 - DNA, 25 bp, Artificial sequence
  Synthetic oligonucleotide
ccgcagccagcctgcagagcgaaca

SEQ ID NO: 726126 - DNA, 25 bp, Artificial sequence
  Synthetic oligonucleotide
gtggcaccgcagccagcctgcagag

SEQ ID NO: 726127 - DNA, 25 bp, Artificial sequence
  Synthetic oligonucleotide
gcaccgccgatgccgaagggcgtat

SEQ ID NO: 726128 - DNA, 25 bp, Artificial sequence
  Synthetic oligonucleotide
cggcctcgatcggtggcaccgcagc

SEQ ID NO: 726129 - DNA, 25 bp, Artificial sequence
  Synthetic oligonucleotide
gccgatgccgaagggcgtatcgcca

SEQ ID NO: 726130 - DNA, 25 bp, Artificial sequence
  Synthetic oligonucleotide
tggaccagctctcggcctcgatcgg

SEQ ID NO: 726131 - DNA, 25 bp, Artificial sequence
  Synthetic oligonucleotide
caacgtctggaccagctctcggcct

SEQ ID NO: 726132 - DNA, 25 bp, Artificial sequence
  Synthetic oligonucleotide
accgcgcaacgtctggaccagctct

SEQ ID NO: 726133 - DNA, 25 bp, Artificial sequence
  Synthetic oligonucleotide
caggccaccgcgcaacgtctggacc

SEQ ID NO: 726134 - DNA, 25 bp, Artificial sequence
  Synthetic oligonucleotide
gatcgccaggccaccgcgcaacgtc

SEQ ID NO: 726135 - DNA, 25 bp, Artificial sequence
  Synthetic oligonucleotide
accagcgatcgccaggccaccgcgc

SEQ ID NO: 726136 - DNA, 25 bp, Artificial sequence
  Synthetic oligonucleotide
gtcgcgaccagcgatcgccaggcca

SEQ ID NO: 726137 - DNA, 25 bp, Artificial sequence
  Synthetic oligonucleotide
gaacgggtcgcgaccagcgatcgcc

SEQ ID NO: 726138 - DNA, 25 bp, Artificial sequence
  Synthetic oligonucleotide
acggtggaacgggtcgcgaccagcg

SEQ ID NO: 726139 - DNA, 25 bp, Artificial sequence
  Synthetic oligonucleotide
tatcgccacggtggaacgggtcgcg

SEQ ID NO: 726140 - DNA, 25 bp, Artificial sequence
  Synthetic oligonucleotide
agggcgtatcgccacggtggaacgg

SEQ ID NO: 726141 - DNA, 25 bp, Artificial sequence
  Synthetic oligonucleotide
agccttaccgcccaggcatcgcgcc

SEQ ID NO: 726142 - DNA, 25 bp, Artificial sequence
  Synthetic oligonucleotide
cgatcggtggcaccgcagccagcct

SEQ ID NO: 726143 - DNA, 25 bp, Artificial sequence
  Synthetic oligonucleotide
tgaccgagggcgtgcagcgcctggg

SEQ ID NO: 726144 - DNA, 25 bp, Artificial sequence
  Synthetic oligonucleotide
gcgacagcccgaccctggtgcgcct

SEQ ID NO: 726145 - DNA, 25 bp, Artificial sequence
  Synthetic oligonucleotide
agccgctgggcggggaggagagccg

SEQ ID NO: 726146 - DNA, 25 bp, Artificial sequence
  Synthetic oligonucleotide
gcggcgagccgctgggcggggagga

SEQ ID NO: 726147 - DNA, 25 bp, Artificial sequence
  Synthetic oligonucleotide
gcttcggcggcgagccgctgggcgg

SEQ ID NO: 726148 - DNA, 25 bp, Artificial sequence
  Synthetic oligonucleotide
gcctgggcttcggcggcgagccgct

SEQ ID NO: 726149 - DNA, 25 bp, Artificial sequence
  Synthetic oligonucleotide
gggaggagagccgcgacccggtcgc

SEQ ID NO: 726150 - DNA, 25 bp, Artificial sequence
  Synthetic oligonucleotide
agggcgtgcagcgcctgggcttcgg

SEQ ID NO: 726151 - DNA, 25 bp, Artificial sequence
  Synthetic oligonucleotide
agagccgcgacccggtcgcggcgtt

SEQ ID NO: 726152 - DNA, 25 bp, Artificial sequence
  Synthetic oligonucleotide
ggtcggtgaccgagggcgtgcagcg

SEQ ID NO: 726153 - DNA, 25 bp, Artificial sequence
  Synthetic oligonucleotide
atgcctggtcggtgaccgagggcgt

SEQ ID NO: 726154 - DNA, 25 bp, Artificial sequence
  Synthetic oligonucleotide
gcctgtatgcctggtcggtgaccga

SEQ ID NO: 726155 - DNA, 25 bp, Artificial sequence
  Synthetic oligonucleotide
gccttggcctgtatgcctggtcggt

SEQ ID NO: 726156 - DNA, 25 bp, Artificial sequence
  Synthetic oligonucleotide
aggcgcggccttggcctgtatgcct

SEQ ID NO: 726157 - DNA, 25 bp, Artificial sequence
  Synthetic oligonucleotide
cggtcaggcgcggccttggcctgta

SEQ ID NO: 726158 - DNA, 25 bp, Artificial sequence
  Synthetic oligonucleotide
tgcagcgcctgggcttcggcggcga

SEQ ID NO: 726159 - DNA, 25 bp, Artificial sequence
  Synthetic oligonucleotide
atcagcaggcgaatctctacgtgct

SEQ ID NO: 726160 - DNA, 25 bp, Artificial sequence
  Synthetic oligonucleotide
cagaacagacagtccatgggcgatt

SEQ ID NO: 726161 - DNA, 25 bp, Artificial sequence
  Synthetic oligonucleotide
atcctttccttggcgacagcccgac

SEQ ID NO: 726162 - DNA, 25 bp, Artificial sequence
  Synthetic oligonucleotide
acctgcatcctttccttggcgacag

SEQ ID NO: 726163 - DNA, 25 bp, Artificial sequence
  Synthetic oligonucleotide
tctgcgacctgcatcctttccttgg

SEQ ID NO: 726164 - DNA, 25 bp, Artificial sequence
  Synthetic oligonucleotide
acgtgctctgcgacctgcatccttt

SEQ ID NO: 726165 - DNA, 25 bp, Artificial sequence
  Synthetic oligonucleotide
tgggcggggaggagagccgcgaccc

SEQ ID NO: 726166 - DNA, 25 bp, Artificial sequence
  Synthetic oligonucleotide
aggcgaatctctacgtgctctgcga

SEQ ID NO: 726167 - DNA, 25 bp, Artificial sequence
  Synthetic oligonucleotide
aaaccctcaccggcctggcggtcag

SEQ ID NO: 726168 - DNA, 25 bp, Artificial sequence
  Synthetic oligonucleotide
agcacgatcagcaggcgaatctcta

SEQ ID NO: 726169 - DNA, 25 bp, Artificial sequence
  Synthetic oligonucleotide
tgatcaagcacgatcagcaggcgaa

SEQ ID NO: 726170 - DNA, 25 bp, Artificial sequence
  Synthetic oligonucleotide
tgcgcttgatcaagcacgatcagca

SEQ ID NO: 726171 - DNA, 25 bp, Artificial sequence
  Synthetic oligonucleotide
cggcgttgcgcttgatcaagcacga

SEQ ID NO: 726172 - DNA, 25 bp, Artificial sequence
  Synthetic oligonucleotide
cggtcgcggcgttgcgcttgatcaa

SEQ ID NO: 726173 - DNA, 25 bp, Artificial sequence
  Synthetic oligonucleotide
gcgacccggtcgcggcgttgcgctt

SEQ ID NO: 726174 - DNA, 25 bp, Artificial sequence
  Synthetic oligonucleotide
atctctacgtgctctgcgacctgca

SEQ ID NO: 726175 - DNA, 25 bp, Artificial sequence
  Synthetic oligonucleotide
ttcccgagtgtagcggtgcccgtcg

SEQ ID NO: 726176 - DNA, 25 bp, Artificial sequence
  Synthetic oligonucleotide
gaaggagccgcagtgaagaacgaca

SEQ ID NO: 726177 - DNA, 25 bp, Artificial sequence
  Synthetic oligonucleotide
aagcgtgaaggagccgcagtgaaga

SEQ ID NO: 726178 - DNA, 25 bp, Artificial sequence
  Synthetic oligonucleotide
cgcccaagcgtgaaggagccgcagt

SEQ ID NO: 726179 - DNA, 25 bp, Artificial sequence
  Synthetic oligonucleotide
tcgcgaccgcccaagcgtgaaggag

SEQ ID NO: 726180 - DNA, 25 bp, Artificial sequence
  Synthetic oligonucleotide
tgcccgtcgcgaccgcccaagcgtg

SEQ ID NO: 726181 - DNA, 25 bp, Artificial sequence
  Synthetic oligonucleotide
gcctggcggtcaggcgcggccttgg

SEQ ID NO: 726182 - DNA, 25 bp, Artificial sequence
  Synthetic oligonucleotide
agtgtagcggtgcccgtcgcgaccg

SEQ ID NO: 726183 - DNA, 25 bp, Artificial sequence
  Synthetic oligonucleotide
acgacatacacgacctcggcctggt

SEQ ID NO: 726184 - DNA, 25 bp, Artificial sequence
  Synthetic oligonucleotide
gtgctttcccgagtgtagcggtgcc

SEQ ID NO: 726185 - DNA, 25 bp, Artificial sequence
  Synthetic oligonucleotide
cctcgggtgctttcccgagtgtagc

SEQ ID NO: 726186 - DNA, 25 bp, Artificial sequence
  Synthetic oligonucleotide
ctccggcctcgggtgctttcccgag

SEQ ID NO: 726187 - DNA, 25 bp, Artificial sequence
  Synthetic oligonucleotide
cgattcctccggcctcgggtgcttt

SEQ ID NO: 726188 - DNA, 25 bp, Artificial sequence
  Synthetic oligonucleotide
ccatgggcgattcctccggcctcgg

SEQ ID NO: 726189 - DNA, 25 bp, Artificial sequence
  Synthetic oligonucleotide
ggccgtagaagatcggattgaggac

SEQ ID NO: 726190 - DNA, 25 bp, Artificial sequence
  Synthetic oligonucleotide
agcggtgcccgtcgcgaccgcccaa

SEQ ID NO: 726191 - DNA, 25 bp, Artificial sequence
  Synthetic oligonucleotide
ggtcaagctgatcctgatcgagtcc

SEQ ID NO: 726192 - DNA, 25 bp, Artificial sequence
  Synthetic oligonucleotide
gcccgaccctggtgcgcctgctcaa

SEQ ID NO: 726193 - DNA, 25 bp, Artificial sequence
  Synthetic oligonucleotide
tgatggaaaccctcaccggcctggc

SEQ ID NO: 726194 - DNA, 25 bp, Artificial sequence
  Synthetic oligonucleotide
cgaaggtgatggaaaccctcaccgg

SEQ ID NO: 726195 - DNA, 25 bp, Artificial sequence
  Synthetic oligonucleotide
acgagccgaaggtgatggaaaccct

SEQ ID NO: 726196 - DNA, 25 bp, Artificial sequence
  Synthetic oligonucleotide
cctgggacgagccgaaggtgatgga

SEQ ID NO: 726197 - DNA, 25 bp, Artificial sequence
  Synthetic oligonucleotide
tcgagtcctgggacgagccgaaggt

SEQ ID NO: 726198 - DNA, 25 bp, Artificial sequence
  Synthetic oligonucleotide
gccgcagtgaagaacgacatacacg

SEQ ID NO: 726199 - DNA, 25 bp, Artificial sequence
  Synthetic oligonucleotide
gctgatcctgatcgagtcctgggac

SEQ ID NO: 726200 - DNA, 25 bp, Artificial sequence
  Synthetic oligonucleotide
gtgaagaacgacatacacgacctcg

SEQ ID NO: 726201 - DNA, 25 bp, Artificial sequence
  Synthetic oligonucleotide
ttcccgggtcaagctgatcctgatc

SEQ ID NO: 726202 - DNA, 25 bp, Artificial sequence
  Synthetic oligonucleotide
cctggattcccgggtcaagctgatc

SEQ ID NO: 726203 - DNA, 25 bp, Artificial sequence
  Synthetic oligonucleotide
cctggtcctggattcccgggtcaag

SEQ ID NO: 726204 - DNA, 25 bp, Artificial sequence
  Synthetic oligonucleotide
cctcggcctggtcctggattcccgg

SEQ ID NO: 726205 - DNA, 25 bp, Artificial sequence
  Synthetic oligonucleotide
acacgacctcggcctggtcctggat

SEQ ID NO: 726206 - DNA, 25 bp, Artificial sequence
  Synthetic oligonucleotide
tcaccggcctggcggtcaggcgcgg

SEQ ID NO: 726207 - DNA, 25 bp, Artificial sequence
  Synthetic oligonucleotide
tcctgatcgagtcctgggacgagcc

SEQ ID NO: 726208 - DNA, 25 bp, Artificial sequence
  Synthetic oligonucleotide
cagcaggtggtgaagaacctgcgcg

SEQ ID NO: 726209 - DNA, 25 bp, Artificial sequence
  Synthetic oligonucleotide
tccttggcgacagcccgaccctggt

SEQ ID NO: 726210 - DNA, 25 bp, Artificial sequence
  Synthetic oligonucleotide
atgccgaggcgcgactgctggcgcg

SEQ ID NO: 726211 - DNA, 25 bp, Artificial sequence
  Synthetic oligonucleotide
tcagccatgccgaggcgcgactgct

SEQ ID NO: 726212 - DNA, 25 bp, Artificial sequence
  Synthetic oligonucleotide
cggactcagccatgccgaggcgcga

SEQ ID NO: 726213 - DNA, 25 bp, Artificial sequence
  Synthetic oligonucleotide
ctgcgcggactcagccatgccgagg

SEQ ID NO: 726214 - DNA, 25 bp, Artificial sequence
  Synthetic oligonucleotide
actgctggcgcgcaacgtgatctgc

SEQ ID NO: 726215 - DNA, 25 bp, Artificial sequence
  Synthetic oligonucleotide
gtggtgaagaacctgcgcggactca

SEQ ID NO: 726216 - DNA, 25 bp, Artificial sequence
  Synthetic oligonucleotide
ggcgcgcaacgtgatctgcaacgat

SEQ ID NO: 726217 - DNA, 25 bp, Artificial sequence
  Synthetic oligonucleotide
accctgcagcaggtggtgaagaacc

SEQ ID NO: 726218 - DNA, 25 bp, Artificial sequence
  Synthetic oligonucleotide
aaccgcaccctgcagcaggtggtga

SEQ ID NO: 726219 - DNA, 25 bp, Artificial sequence
  Synthetic oligonucleotide
accgacaaccgcaccctgcagcagg

SEQ ID NO: 726220 - DNA, 25 bp, Artificial sequence
  Synthetic oligonucleotide
gtgcgcaccgacaaccgcaccctgc

SEQ ID NO: 726221 - DNA, 25 bp, Artificial sequence
  Synthetic oligonucleotide
gcccgcgtgcgcaccgacaaccgca

SEQ ID NO: 726222 - DNA, 25 bp, Artificial sequence
  Synthetic oligonucleotide
cgtggtgcccgcgtgcgcaccgaca

SEQ ID NO: 726223 - DNA, 25 bp, Artificial sequence
  Synthetic oligonucleotide
aagaacctgcgcggactcagccatg

SEQ ID NO: 726224 - DNA, 25 bp, Artificial sequence
  Synthetic oligonucleotide
acctgcccgagctgaaccgcaccaa

SEQ ID NO: 726225 - DNA, 25 bp, Artificial sequence
  Synthetic oligonucleotide
tggagggcgtgctgagcttcgagta

SEQ ID NO: 726226 - DNA, 25 bp, Artificial sequence
  Synthetic oligonucleotide
tcgacctggagggcgtgctgagctt

SEQ ID NO: 726227 - DNA, 25 bp, Artificial sequence
  Synthetic oligonucleotide
agctactcgacctggagggcgtgct

SEQ ID NO: 726228 - DNA, 25 bp, Artificial sequence
  Synthetic oligonucleotide
agttccagctactcgacctggaggg

SEQ ID NO: 726229 - DNA, 25 bp, Artificial sequence
  Synthetic oligonucleotide
gcaccaagttccagctactcgacct

SEQ ID NO: 726230 - DNA, 25 bp, Artificial sequence
  Synthetic oligonucleotide
aggcgcgactgctggcgcgcaacgt

SEQ ID NO: 726231 - DNA, 25 bp, Artificial sequence
  Synthetic oligonucleotide
cgagctgaaccgcaccaagttccag

SEQ ID NO: 726232 - DNA, 25 bp, Artificial sequence
  Synthetic oligonucleotide
cgcgctggagcgagcgcaaccgtgg

SEQ ID NO: 726233 - DNA, 25 bp, Artificial sequence
  Synthetic oligonucleotide
aggaggacctgcccgagctgaaccg

SEQ ID NO: 726234 - DNA, 25 bp, Artificial sequence
  Synthetic oligonucleotide
tcacccaggaggacctgcccgagct

SEQ ID NO: 726235 - DNA, 25 bp, Artificial sequence
  Synthetic oligonucleotide
gggcgatcacccaggaggacctgcc

SEQ ID NO: 726236 - DNA, 25 bp, Artificial sequence
  Synthetic oligonucleotide
aacgatggggcgatcacccaggagg

SEQ ID NO: 726237 - DNA, 25 bp, Artificial sequence
  Synthetic oligonucleotide
atctgcaacgatggggcgatcaccc

SEQ ID NO: 726238 - DNA, 25 bp, Artificial sequence
  Synthetic oligonucleotide
aacgtgatctgcaacgatggggcga

SEQ ID NO: 726239 - DNA, 25 bp, Artificial sequence
  Synthetic oligonucleotide
tgaaccgcaccaagttccagctact

SEQ ID NO: 726240 - DNA, 25 bp, Artificial sequence
  Synthetic oligonucleotide
aaggcaatcatcgaccgaccgtggt

SEQ ID NO: 726241 - DNA, 25 bp, Artificial sequence
  Synthetic oligonucleotide
tgaagctgccggccgaagtgcagcg

SEQ ID NO: 726242 - DNA, 25 bp, Artificial sequence
  Synthetic oligonucleotide
atgcgctgaagctgccggccgaagt

SEQ ID NO: 726243 - DNA, 25 bp, Artificial sequence
  Synthetic oligonucleotide
tgtcccatgcgctgaagctgccggc

SEQ ID NO: 726244 - DNA, 25 bp, Artificial sequence
  Synthetic oligonucleotide
tgctggtgtcccatgcgctgaagct

SEQ ID NO: 726245 - DNA, 25 bp, Artificial sequence
  Synthetic oligonucleotide
ccgtggtgctggtgtcccatgcgct

SEQ ID NO: 726246 - DNA, 25 bp, Artificial sequence
  Synthetic oligonucleotide
gcgcaaccgtggtgcccgcgtgcgc

SEQ ID NO: 726247 - DNA, 25 bp, Artificial sequence
  Synthetic oligonucleotide
atcatcgaccgaccgtggtgctggt

SEQ ID NO: 726248 - DNA, 25 bp, Artificial sequence
  Synthetic oligonucleotide
aagtgcagcgcttcgccgcgcggtt

SEQ ID NO: 726249 - DNA, 25 bp, Artificial sequence
  Synthetic oligonucleotide
tggccgaaggcaatcatcgaccgac

SEQ ID NO: 726250 - DNA, 25 bp, Artificial sequence
  Synthetic oligonucleotide
tcgccatggccgaaggcaatcatcg

SEQ ID NO: 726251 - DNA, 25 bp, Artificial sequence
  Synthetic oligonucleotide
aggaaatcgccatggccgaaggcaa

SEQ ID NO: 726252 - DNA, 25 bp, Artificial sequence
  Synthetic oligonucleotide
tgctcaaggaaatcgccatggccga

SEQ ID NO: 726253 - DNA, 25 bp, Artificial sequence
  Synthetic oligonucleotide
tgcgcctgctcaaggaaatcgccat

SEQ ID NO: 726254 - DNA, 25 bp, Artificial sequence
  Synthetic oligonucleotide
ccctggtgcgcctgctcaaggaaat

SEQ ID NO: 726255 - DNA, 25 bp, Artificial sequence
  Synthetic oligonucleotide
gaccgaccgtggtgctggtgtccca

SEQ ID NO: 726256 - DNA, 25 bp, Artificial sequence
  Synthetic oligonucleotide
tgcccagcgaggacgaactgctcgg

SEQ ID NO: 726257 - DNA, 25 bp, Artificial sequence
  Synthetic oligonucleotide
atcttgcagaacagacagtccatgg

SEQ ID NO: 726258 - DNA, 25 bp, Artificial sequence
  Synthetic oligonucleotide
aagcgacgcgctggagcgagcgcaa

SEQ ID NO: 726259 - DNA, 25 bp, Artificial sequence
  Synthetic oligonucleotide
cgaggaagcgacgcgctggagcgag

SEQ ID NO: 726260 - DNA, 25 bp, Artificial sequence
  Synthetic oligonucleotide
gtccgcgaggaagcgacgcgctgga

SEQ ID NO: 726261 - DNA, 25 bp, Artificial sequence
  Synthetic oligonucleotide
ggcatcgtccgcgaggaagcgacgc

SEQ ID NO: 726262 - DNA, 25 bp, Artificial sequence
  Synthetic oligonucleotide
tgctcggcatcgtccgcgaggaagc

SEQ ID NO: 726263 - DNA, 25 bp, Artificial sequence
  Synthetic oligonucleotide
ctgccggccgaagtgcagcgcttcg

SEQ ID NO: 726264 - DNA, 25 bp, Artificial sequence
  Synthetic oligonucleotide
gcgaggacgaactgctcggcatcgt

SEQ ID NO: 726265 - DNA, 25 bp, Artificial sequence
  Synthetic oligonucleotide
ggccgaagtgcagcgcttcgccgcg

SEQ ID NO: 726266 - DNA, 25 bp, Artificial sequence
  Synthetic oligonucleotide
tgtccctgcccagcgaggacgaact

SEQ ID NO: 726267 - DNA, 25 bp, Artificial sequence
  Synthetic oligonucleotide
ttctcgctgtccctgcccagcgagg

SEQ ID NO: 726268 - DNA, 25 bp, Artificial sequence
  Synthetic oligonucleotide
gcgcggttctcgctgtccctgccca

SEQ ID NO: 726269 - DNA, 25 bp, Artificial sequence
  Synthetic oligonucleotide
ttcgccgcgcggttctcgctgtccc

SEQ ID NO: 726270 - DNA, 25 bp, Artificial sequence
  Synthetic oligonucleotide
agcgcttcgccgcgcggttctcgct

SEQ ID NO: 726271 - DNA, 25 bp, Artificial sequence
  Synthetic oligonucleotide
gagcgagcgcaaccgtggtgcccgc

SEQ ID NO: 726272 - DNA, 25 bp, Artificial sequence
  Synthetic oligonucleotide
cgaactgctcggcatcgtccgcgag

SEQ ID NO: 726273 - DNA, 25 bp, Artificial sequence
  Synthetic oligonucleotide
atcgggttccacgatggccggcgac

SEQ ID NO: 726274 - DNA, 25 bp, Artificial sequence
  Synthetic oligonucleotide
agatcgcaccagtttaccggaagtg

SEQ ID NO: 726275 - DNA, 25 bp, Artificial sequence
  Synthetic oligonucleotide
tggccgctgaacggcagcagggtgc

SEQ ID NO: 726276 - DNA, 25 bp, Artificial sequence
  Synthetic oligonucleotide
gccggctggccgctgaacggcagca

SEQ ID NO: 726277 - DNA, 25 bp, Artificial sequence
  Synthetic oligonucleotide
ggtcgcgccggctggccgctgaacg

SEQ ID NO: 726278 - DNA, 25 bp, Artificial sequence
  Synthetic oligonucleotide
cggcgacggtcgcgccggctggccg

SEQ ID NO: 726279 - DNA, 25 bp, Artificial sequence
  Synthetic oligonucleotide
ggcagcagggtgcgcagggcggagt

SEQ ID NO: 726280 - DNA, 25 bp, Artificial sequence
  Synthetic oligonucleotide
ttccacgatggccggcgacggtcgc

SEQ ID NO: 726281 - DNA, 25 bp, Artificial sequence
  Synthetic oligonucleotide
agggtgcgcagggcggagtcggcct

SEQ ID NO: 726282 - DNA, 25 bp, Artificial sequence
  Synthetic oligonucleotide
tcgccatcgggttccacgatggccg

SEQ ID NO: 726283 - DNA, 25 bp, Artificial sequence
  Synthetic oligonucleotide
ctcagttcgccatcgggttccacga

SEQ ID NO: 726284 - DNA, 25 bp, Artificial sequence
  Synthetic oligonucleotide
tcctcgctcagttcgccatcgggtt

SEQ ID NO: 726285 - DNA, 25 bp, Artificial sequence
  Synthetic oligonucleotide
gtgtcttcctcgctcagttcgccat

SEQ ID NO: 726286 - DNA, 25 bp, Artificial sequence
  Synthetic oligonucleotide
tggcgggtgtcttcctcgctcagtt

SEQ ID NO: 726287 - DNA, 25 bp, Artificial sequence
  Synthetic oligonucleotide
gcgatatggcgggtgtcttcctcgc

SEQ ID NO: 726288 - DNA, 25 bp, Artificial sequence
  Synthetic oligonucleotide
gatggccggcgacggtcgcgccggc

SEQ ID NO: 726289 - DNA, 25 bp, Artificial sequence
  Synthetic oligonucleotide
atgggcgaatagtggcggtcggcgg

SEQ ID NO: 726290 - DNA, 25 bp, Artificial sequence
  Synthetic oligonucleotide
gacagtccatgggcgattcctccgg

SEQ ID NO: 726291 - DNA, 25 bp, Artificial sequence
  Synthetic oligonucleotide
ctccggaaacgaaagatcgcaccag

SEQ ID NO: 726292 - DNA, 25 bp, Artificial sequence
  Synthetic oligonucleotide
gcgcacctccggaaacgaaagatcg

SEQ ID NO: 726293 - DNA, 25 bp, Artificial sequence
  Synthetic oligonucleotide
gacatggcgcacctccggaaacgaa

SEQ ID NO: 726294 - DNA, 25 bp, Artificial sequence
  Synthetic oligonucleotide
tcggcggacatggcgcacctccgga

SEQ ID NO: 726295 - DNA, 25 bp, Artificial sequence
  Synthetic oligonucleotide
ctgaacggcagcagggtgcgcaggg

SEQ ID NO: 726296 - DNA, 25 bp, Artificial sequence
  Synthetic oligonucleotide
gaatagtggcggtcggcggacatgg

SEQ ID NO: 726297 - DNA, 25 bp, Artificial sequence
  Synthetic oligonucleotide
ttgatgcgcatcaggccggcgatat

SEQ ID NO: 726298 - DNA, 25 bp, Artificial sequence
  Synthetic oligonucleotide
cggtcgatgggcgaatagtggcggt

SEQ ID NO: 726299 - DNA, 25 bp, Artificial sequence
  Synthetic oligonucleotide
aggaaacggtcgatgggcgaatagt

SEQ ID NO: 726300 - DNA, 25 bp, Artificial sequence
  Synthetic oligonucleotide
tgcagcaggaaacggtcgatgggcg

SEQ ID NO: 726301 - DNA, 25 bp, Artificial sequence
  Synthetic oligonucleotide
tcggcctgcagcaggaaacggtcga

SEQ ID NO: 726302 - DNA, 25 bp, Artificial sequence
  Synthetic oligonucleotide
gcggagtcggcctgcagcaggaaac

SEQ ID NO: 726303 - DNA, 25 bp, Artificial sequence
  Synthetic oligonucleotide
cgcagggcggagtcggcctgcagca

SEQ ID NO: 726304 - DNA, 25 bp, Artificial sequence
  Synthetic oligonucleotide
tggcggtcggcggacatggcgcacc

SEQ ID NO: 726305 - DNA, 25 bp, Artificial sequence
  Synthetic oligonucleotide
actggcggatgcgttgctcgcacca

SEQ ID NO: 726306 - DNA, 25 bp, Artificial sequence
  Synthetic oligonucleotide
tcctcctcggcggcttcctccatcg

SEQ ID NO: 726307 - DNA, 25 bp, Artificial sequence
  Synthetic oligonucleotide
gtcgatctcctcctcggcggcttcc

SEQ ID NO: 726308 - DNA, 25 bp, Artificial sequence
  Synthetic oligonucleotide
caggtggtcgatctcctcctcggcg

SEQ ID NO: 726309 - DNA, 25 bp, Artificial sequence
  Synthetic oligonucleotide
ccaggccaggtggtcgatctcctcc

SEQ ID NO: 726310 - DNA, 25 bp, Artificial sequence
  Synthetic oligonucleotide
tcgcaccaggccaggtggtcgatct

SEQ ID NO: 726311 - DNA, 25 bp, Artificial sequence
  Synthetic oligonucleotide
aggccggcgatatggcgggtgtctt

SEQ ID NO: 726312 - DNA, 25 bp, Artificial sequence
  Synthetic oligonucleotide
ggatgcgttgctcgcaccaggccag

SEQ ID NO: 726313 - DNA, 25 bp, Artificial sequence
  Synthetic oligonucleotide
ctccatcgcctcgcggacctcgggc

SEQ ID NO: 726314 - DNA, 25 bp, Artificial sequence
  Synthetic oligonucleotide
tgcccaactggcggatgcgttgctc

SEQ ID NO: 726315 - DNA, 25 bp, Artificial sequence
  Synthetic oligonucleotide
gacggctgcccaactggcggatgcg

SEQ ID NO: 726316 - DNA, 25 bp, Artificial sequence
  Synthetic oligonucleotide
cgctgggacggctgcccaactggcg

SEQ ID NO: 726317 - DNA, 25 bp, Artificial sequence
  Synthetic oligonucleotide
tgaggacgctgggacggctgcccaa

SEQ ID NO: 726318 - DNA, 25 bp, Artificial sequence
  Synthetic oligonucleotide
tcggattgaggacgctgggacggct

SEQ ID NO: 726319 - DNA, 25 bp, Artificial sequence
  Synthetic oligonucleotide
agaagatcggattgaggacgctggg

SEQ ID NO: 726320 - DNA, 25 bp, Artificial sequence
  Synthetic oligonucleotide
gttgctcgcaccaggccaggtggtc

SEQ ID NO: 726321 - DNA, 25 bp, Artificial sequence
  Synthetic oligonucleotide
agcgactggccctggtacagcgcct

SEQ ID NO: 726322 - DNA, 25 bp, Artificial sequence
  Synthetic oligonucleotide
caccagtttaccggaagtgcgctga

SEQ ID NO: 726323 - DNA, 25 bp, Artificial sequence
  Synthetic oligonucleotide
gtgtggttgatgcgcatcaggccgg

SEQ ID NO: 726324 - DNA, 25 bp, Artificial sequence
  Synthetic oligonucleotide
tcgccggtgtggttgatgcgcatca

SEQ ID NO: 726325 - DNA, 25 bp, Artificial sequence
  Synthetic oligonucleotide
cagacctcgccggtgtggttgatgc

SEQ ID NO: 726326 - DNA, 25 bp, Artificial sequence
  Synthetic oligonucleotide
tgggcgcagacctcgccggtgtggt

SEQ ID NO: 726327 - DNA, 25 bp, Artificial sequence
  Synthetic oligonucleotide
agcgcctgggcgcagacctcgccgg

SEQ ID NO: 726328 - DNA, 25 bp, Artificial sequence
  Synthetic oligonucleotide
tcggcggcttcctccatcgcctcgc

SEQ ID NO: 726329 - DNA, 25 bp, Artificial sequence
  Synthetic oligonucleotide
tggccctggtacagcgcctgggcgc

SEQ ID NO: 726330 - DNA, 25 bp, Artificial sequence
  Synthetic oligonucleotide
gcttcctccatcgcctcgcggacct

SEQ ID NO: 726331 - DNA, 25 bp, Artificial sequence
  Synthetic oligonucleotide
gcggtcagcgactggccctggtaca

SEQ ID NO: 726332 - DNA, 25 bp, Artificial sequence
  Synthetic oligonucleotide
agcttggcggtcagcgactggccct

SEQ ID NO: 726333 - DNA, 25 bp, Artificial sequence
  Synthetic oligonucleotide
tcgggcagcttggcggtcagcgact

SEQ ID NO: 726334 - DNA, 25 bp, Artificial sequence
  Synthetic oligonucleotide
cggacctcgggcagcttggcggtca

SEQ ID NO: 726335 - DNA, 25 bp, Artificial sequence
  Synthetic oligonucleotide
gcctcgcggacctcgggcagcttgg

SEQ ID NO: 726336 - DNA, 25 bp, Artificial sequence
  Synthetic oligonucleotide
cgcatcaggccggcgatatggcggg

SEQ ID NO: 726337 - DNA, 25 bp, Artificial sequence
  Synthetic oligonucleotide
tggtacagcgcctgggcgcagacct

SEQ ID NO: 726338 - DNA, 25 bp, Artificial sequence
  Synthetic oligonucleotide
ggccggtctgcctcggtcaggtgct

SEQ ID NO: 726339 - DNA, 25 bp, Artificial sequence
  Synthetic oligonucleotide
aacgaaagatcgcaccagtttaccg

SEQ ID NO: 726340 - DNA, 25 bp, Artificial sequence
  Synthetic oligonucleotide
tgtgccttttcgggatgaccaggaa

SEQ ID NO: 726341 - DNA, 25 bp, Artificial sequence
  Synthetic oligonucleotide
tgggaatgtgccttttcgggatgac

SEQ ID NO: 726342 - DNA, 25 bp, Artificial sequence
  Synthetic oligonucleotide
tcgagggtgggaatgtgccttttcg

SEQ ID NO: 726343 - DNA, 25 bp, Artificial sequence
  Synthetic oligonucleotide
caggtgctcgagggtgggaatgtgc

SEQ ID NO: 726344 - DNA, 25 bp, Artificial sequence
  Synthetic oligonucleotide
ggatgaccaggaagtgcaccggcgc

SEQ ID NO: 726345 - DNA, 25 bp, Artificial sequence
  Synthetic oligonucleotide
tctgcctcggtcaggtgctcgaggg

SEQ ID NO: 726346 - DNA, 25 bp, Artificial sequence
  Synthetic oligonucleotide
accaggaagtgcaccggcgcctgcg

SEQ ID NO: 726347 - DNA, 25 bp, Artificial sequence
  Synthetic oligonucleotide
gccagcggccggtctgcctcggtca

SEQ ID NO: 726348 - DNA, 25 bp, Artificial sequence
  Synthetic oligonucleotide
tggcctgccagcggccggtctgcct

SEQ ID NO: 726349 - DNA, 25 bp, Artificial sequence
  Synthetic oligonucleotide
aggatatggcctgccagcggccggt

SEQ ID NO: 726350 - DNA, 25 bp, Artificial sequence
  Synthetic oligonucleotide
gtgaagaggatatggcctgccagcg

SEQ ID NO: 726351 - DNA, 25 bp, Artificial sequence
  Synthetic oligonucleotide
tgggcggtgaagaggatatggcctg

SEQ ID NO: 726352 - DNA, 25 bp, Artificial sequence
  Synthetic oligonucleotide
ggcgctgggcggtgaagaggatatg

SEQ ID NO: 726353 - DNA, 25 bp, Artificial sequence
  Synthetic oligonucleotide
ctcggtcaggtgctcgagggtggga

SEQ ID NO: 726354 - DNA, 25 bp, Artificial sequence
  Synthetic oligonucleotide
gacaacttcctcgtcttcgtagaac

SEQ ID NO: 726355 - DNA, 25 bp, Artificial sequence
  Synthetic oligonucleotide
gccacgatcttgcagaacagacagt

SEQ ID NO: 726356 - DNA, 25 bp, Artificial sequence
  Synthetic oligonucleotide
tcccccgccacgatcttgcagaaca

SEQ ID NO: 726357 - DNA, 25 bp, Artificial sequence
  Synthetic oligonucleotide
ggaacttcccccgccacgatcttgc

SEQ ID NO: 726358 - DNA, 25 bp, Artificial sequence
  Synthetic oligonucleotide
ttgcgcgcgggaacttcccccgcca

SEQ ID NO: 726359 - DNA, 25 bp, Artificial sequence
  Synthetic oligonucleotide
tagaacttgcgcgcgggaacttccc

SEQ ID NO: 726360 - DNA, 25 bp, Artificial sequence
  Synthetic oligonucleotide
ttttcgggatgaccaggaagtgcac

SEQ ID NO: 726361 - DNA, 25 bp, Artificial sequence
  Synthetic oligonucleotide
ttcctcgtcttcgtagaacttgcgc

SEQ ID NO: 726362 - DNA, 25 bp, Artificial sequence
  Synthetic oligonucleotide
agccctgctcccgggccaggcgctg

SEQ ID NO: 726363 - DNA, 25 bp, Artificial sequence
  Synthetic oligonucleotide
aaacgcgacaacttcctcgtcttcg

SEQ ID NO: 726364 - DNA, 25 bp, Artificial sequence
  Synthetic oligonucleotide
atcgtgaaacgcgacaacttcctcg

SEQ ID NO: 726365 - DNA, 25 bp, Artificial sequence
  Synthetic oligonucleotide
gccgatatcgtgaaacgcgacaact

SEQ ID NO: 726366 - DNA, 25 bp, Artificial sequence
  Synthetic oligonucleotide
ctgcgggccgatatcgtgaaacgcg

SEQ ID NO: 726367 - DNA, 25 bp, Artificial sequence
  Synthetic oligonucleotide
cggcgcctgcgggccgatatcgtga

SEQ ID NO: 726368 - DNA, 25 bp, Artificial sequence
  Synthetic oligonucleotide
agtgcaccggcgcctgcgggccgat

SEQ ID NO: 726369 - DNA, 25 bp, Artificial sequence
  Synthetic oligonucleotide
tcttcgtagaacttgcgcgcgggaa

SEQ ID NO: 726370 - DNA, 25 bp, Artificial sequence
  Synthetic oligonucleotide
cgggctgcgatgtcgcagcgccagc

SEQ ID NO: 726371 - DNA, 25 bp, Artificial sequence
  Synthetic oligonucleotide
ggccagtgcatctggcgttgaccca

SEQ ID NO: 726372 - DNA, 25 bp, Artificial sequence
  Synthetic oligonucleotide
cccggcggccagtgcatctggcgtt

SEQ ID NO: 726373 - DNA, 25 bp, Artificial sequence
  Synthetic oligonucleotide
actcagcccggcggccagtgcatct

SEQ ID NO: 726374 - DNA, 25 bp, Artificial sequence
  Synthetic oligonucleotide
agcagggactcagcccggcggccag

SEQ ID NO: 726375 - DNA, 25 bp, Artificial sequence
  Synthetic oligonucleotide
agcgccagcagggactcagcccggc

SEQ ID NO: 726376 - DNA, 25 bp, Artificial sequence
  Synthetic oligonucleotide
gggccaggcgctgggcggtgaagag

SEQ ID NO: 726377 - DNA, 25 bp, Artificial sequence
  Synthetic oligonucleotide
tgcgatgtcgcagcgccagcaggga

SEQ ID NO: 726378 - DNA, 25 bp, Artificial sequence
  Synthetic oligonucleotide
tgacccagcacgtgcatgtggatgt

SEQ ID NO: 726379 - DNA, 25 bp, Artificial sequence
  Synthetic oligonucleotide
tgcggacgggctgcgatgtcgcagc

SEQ ID NO: 726380 - DNA, 25 bp, Artificial sequence
  Synthetic oligonucleotide
ggatgttgcggacgggctgcgatgt

SEQ ID NO: 726381 - DNA, 25 bp, Artificial sequence
  Synthetic oligonucleotide
atagcaggatgttgcggacgggctg

SEQ ID NO: 726382 - DNA, 25 bp, Artificial sequence
  Synthetic oligonucleotide
gcgctgatagcaggatgttgcggac

SEQ ID NO: 726383 - DNA, 25 bp, Artificial sequence
  Synthetic oligonucleotide
ggaagtgcgctgatagcaggatgtt

SEQ ID NO: 726384 - DNA, 25 bp, Artificial sequence
  Synthetic oligonucleotide
tttaccggaagtgcgctgatagcag

SEQ ID NO: 726385 - DNA, 25 bp, Artificial sequence
  Synthetic oligonucleotide
tgtcgcagcgccagcagggactcag

SEQ ID NO: 726386 - DNA, 25 bp, Artificial sequence
  Synthetic oligonucleotide
gcccgccaaggtcgttgcagttcat

SEQ ID NO: 726387 - DNA, 25 bp, Artificial sequence
  Synthetic oligonucleotide
ttcgagtacgacaccgcgcgcttcg

SEQ ID NO: 726388 - DNA, 25 bp, Artificial sequence
  Synthetic oligonucleotide
cctcgcagccctgctcccgggccag

SEQ ID NO: 726389 - DNA, 25 bp, Artificial sequence
  Synthetic oligonucleotide
agccttcctcgcagccctgctcccg

SEQ ID NO: 726390 - DNA, 25 bp, Artificial sequence
  Synthetic oligonucleotide
cacggaagccttcctcgcagccctg

SEQ ID NO: 726391 - DNA, 25 bp, Artificial sequence
  Synthetic oligonucleotide
tcaccacacggaagccttcctcgca

SEQ ID NO: 726392 - DNA, 25 bp, Artificial sequence
  Synthetic oligonucleotide
agttcatcaccacacggaagccttc

SEQ ID NO: 726393 - DNA, 25 bp, Artificial sequence
  Synthetic oligonucleotide
tgcatctggcgttgacccagcacgt

SEQ ID NO: 726394 - DNA, 25 bp, Artificial sequence
  Synthetic oligonucleotide
caaggtcgttgcagttcatcaccac

SEQ ID NO: 726395 - DNA, 25 bp, Artificial sequence
  Synthetic oligonucleotide
tggcgttgacccagcacgtgcatgt

SEQ ID NO: 726396 - DNA, 25 bp, Artificial sequence
  Synthetic oligonucleotide
cggtctgcccgccaaggtcgttgca

SEQ ID NO: 726397 - DNA, 25 bp, Artificial sequence
  Synthetic oligonucleotide
tggtgcacggtctgcccgccaaggt

SEQ ID NO: 726398 - DNA, 25 bp, Artificial sequence
  Synthetic oligonucleotide
tggatgtggtgcacggtctgcccgc

SEQ ID NO: 726399 - DNA, 25 bp, Artificial sequence
  Synthetic oligonucleotide
tgcatgtggatgtggtgcacggtct

SEQ ID NO: 726400 - DNA, 25 bp, Artificial sequence
  Synthetic oligonucleotide
agcacgtgcatgtggatgtggtgca

SEQ ID NO: 726401 - DNA, 25 bp, Artificial sequence
  Synthetic oligonucleotide
gctcccgggccaggcgctgggcggt

SEQ ID NO: 726402 - DNA, 25 bp, Artificial sequence
  Synthetic oligonucleotide
cgttgcagttcatcaccacacggaa

SEQ ID NO: 726403 - DNA, 25 bp, Artificial sequence
  Synthetic oligonucleotide
atgccgtgcgggttggcccagggca

SEQ ID NO: 726404 - DNA, 25 bp, Artificial sequence
  Synthetic oligonucleotide
caccgaggcgatattgagtatctgg

SEQ ID NO: 726405 - DNA, 25 bp, Artificial sequence
  Synthetic oligonucleotide
cttgacgccgcgctctttcagttct

SEQ ID NO: 726406 - DNA, 25 bp, Artificial sequence
  Synthetic oligonucleotide
ccgagaccttgacgccgcgctcttt

SEQ ID NO: 726407 - DNA, 25 bp, Artificial sequence
  Synthetic oligonucleotide
acagcaccgagaccttgacgccgcg

SEQ ID NO: 726408 - DNA, 25 bp, Artificial sequence
  Synthetic oligonucleotide
cagggcacagcaccgagaccttgac

SEQ ID NO: 726409 - DNA, 25 bp, Artificial sequence
  Synthetic oligonucleotide
tctttcagttcttcccgcaagcctt

SEQ ID NO: 726410 - DNA, 25 bp, Artificial sequence
  Synthetic oligonucleotide
tgcgggttggcccagggcacagcac

SEQ ID NO: 726411 - DNA, 25 bp, Artificial sequence
  Synthetic oligonucleotide
agttcttcccgcaagccttccgaga

SEQ ID NO: 726412 - DNA, 25 bp, Artificial sequence
  Synthetic oligonucleotide
gaagaatgccgtgcgggttggccca

SEQ ID NO: 726413 - DNA, 25 bp, Artificial sequence
  Synthetic oligonucleotide
tcccggaagaatgccgtgcgggttg

SEQ ID NO: 726414 - DNA, 25 bp, Artificial sequence
  Synthetic oligonucleotide
ccggcttcccggaagaatgccgtgc

SEQ ID NO: 726415 - DNA, 25 bp, Artificial sequence
  Synthetic oligonucleotide
cgcatcccggcttcccggaagaatg

SEQ ID NO: 726416 - DNA, 25 bp, Artificial sequence
  Synthetic oligonucleotide
gccgagccgcatcccggcttcccgg

SEQ ID NO: 726417 - DNA, 25 bp, Artificial sequence
  Synthetic oligonucleotide
gagcctgccgagccgcatcccggct

SEQ ID NO: 726418 - DNA, 25 bp, Artificial sequence
  Synthetic oligonucleotide
ttggcccagggcacagcaccgagac

SEQ ID NO: 726419 - DNA, 25 bp, Artificial sequence
  Synthetic oligonucleotide
ttgctggcgtagtagttgctcatcc

SEQ ID NO: 726420 - DNA, 25 bp, Artificial sequence
  Synthetic oligonucleotide
gcgtgctgagcttcgagtacgacac

SEQ ID NO: 726421 - DNA, 25 bp, Artificial sequence
  Synthetic oligonucleotide
ctggaaggcggccaccgaggcgata

SEQ ID NO: 726422 - DNA, 25 bp, Artificial sequence
  Synthetic oligonucleotide
gccgggctggaaggcggccaccgag

SEQ ID NO: 726423 - DNA, 25 bp, Artificial sequence
  Synthetic oligonucleotide
caggcgccgggctggaaggcggcca

SEQ ID NO: 726424 - DNA, 25 bp, Artificial sequence
  Synthetic oligonucleotide
gctcatccaggcgccgggctggaag

SEQ ID NO: 726425 - DNA, 25 bp, Artificial sequence
  Synthetic oligonucleotide
gccgcgctctttcagttcttcccgc

SEQ ID NO: 726426 - DNA, 25 bp, Artificial sequence
  Synthetic oligonucleotide
gcgtagtagttgctcatccaggcgc

SEQ ID NO: 726427 - DNA, 25 bp, Artificial sequence
  Synthetic oligonucleotide
catcagcttgctccggtcgagcctg

SEQ ID NO: 726428 - DNA, 25 bp, Artificial sequence
  Synthetic oligonucleotide
taggccttgctggcgtagtagttgc

SEQ ID NO: 726429 - DNA, 25 bp, Artificial sequence
  Synthetic oligonucleotide
aggacgtaggccttgctggcgtagt

SEQ ID NO: 726430 - DNA, 25 bp, Artificial sequence
  Synthetic oligonucleotide
aagtgcaggacgtaggccttgctgg

SEQ ID NO: 726431 - DNA, 25 bp, Artificial sequence
  Synthetic oligonucleotide
tccgagaagtgcaggacgtaggcct

SEQ ID NO: 726432 - DNA, 25 bp, Artificial sequence
  Synthetic oligonucleotide
aagccttccgagaagtgcaggacgt

SEQ ID NO: 726433 - DNA, 25 bp, Artificial sequence
  Synthetic oligonucleotide
tcccgcaagccttccgagaagtgca

SEQ ID NO: 726434 - DNA, 25 bp, Artificial sequence
  Synthetic oligonucleotide
gtagttgctcatccaggcgccgggc

SEQ ID NO: 726435 - DNA, 25 bp, Artificial sequence
  Synthetic oligonucleotide
atccgcgcggcgagtcggcgcacca

SEQ ID NO: 726436 - DNA, 25 bp, Artificial sequence
  Synthetic oligonucleotide
tgggctcagcgccagcaggcgattg

SEQ ID NO: 726437 - DNA, 25 bp, Artificial sequence
  Synthetic oligonucleotide
ccaggcgtgggctcagcgccagcag

SEQ ID NO: 726438 - DNA, 25 bp, Artificial sequence
  Synthetic oligonucleotide
gtggcgccaggcgtgggctcagcgc

SEQ ID NO: 726439 - DNA, 25 bp, Artificial sequence
  Synthetic oligonucleotide
agccagcgtggcgccaggcgtgggc

SEQ ID NO: 726440 - DNA, 25 bp, Artificial sequence
  Synthetic oligonucleotide
gcgcaccagccagcgtggcgccagg

SEQ ID NO: 726441 - DNA, 25 bp, Artificial sequence
  Synthetic oligonucleotide
ccggtcgagcctgccgagccgcatc

SEQ ID NO: 726442 - DNA, 25 bp, Artificial sequence
  Synthetic oligonucleotide
cggcgagtcggcgcaccagccagcg

SEQ ID NO: 726443 - DNA, 25 bp, Artificial sequence
  Synthetic oligonucleotide
ggcgattgcgccaaccggggacgat

SEQ ID NO: 726444 - DNA, 25 bp, Artificial sequence
  Synthetic oligonucleotide
gcgttgatccgcgcggcgagtcggc

SEQ ID NO: 726445 - DNA, 25 bp, Artificial sequence
  Synthetic oligonucleotide
acgtactggtcgaagtgcatgacgg

SEQ ID NO: 726446 - DNA, 25 bp, Artificial sequence
  Synthetic oligonucleotide
ggtaccgccgaggcgttgatccgcg

SEQ ID NO: 726447 - DNA, 25 bp, Artificial sequence
  Synthetic oligonucleotide
ctgcgaggagaggccggtcaacccc

SEQ ID NO: 726448 - DNA, 25 bp, Artificial sequence
  Synthetic oligonucleotide
tgccgccctgcgaggagaggccggt

SEQ ID NO: 726449 - DNA, 25 bp, Artificial sequence
  Synthetic oligonucleotide
aaccttgccgccctgcgaggagagg

SEQ ID NO: 726450 - DNA, 25 bp, Artificial sequence
  Synthetic oligonucleotide
agtcggcgcaccagccagcgtggcg

SEQ ID NO: 726451 - DNA, 25 bp, Artificial sequence
  Synthetic oligonucleotide
ttcttgtccagcccgcgcagggcca

SEQ ID NO: 726452 - DNA, 25 bp, Artificial sequence
  Synthetic oligonucleotide
ggcgatattgagtatctggcccccg

SEQ ID NO: 726453 - DNA, 25 bp, Artificial sequence
  Synthetic oligonucleotide
gtcatcatcagcttgctccggtcga

SEQ ID NO: 726454 - DNA, 25 bp, Artificial sequence
  Synthetic oligonucleotide
tccggggtcatcatcagcttgctcc

SEQ ID NO: 726455 - DNA, 25 bp, Artificial sequence
  Synthetic oligonucleotide
acttcctccggggtcatcatcagct

SEQ ID NO: 726456 - DNA, 25 bp, Artificial sequence
  Synthetic oligonucleotide
agcgcgacttcctccggggtcatca

SEQ ID NO: 726457 - DNA, 25 bp, Artificial sequence
  Synthetic oligonucleotide
ggccagcagcgcgacttcctccggg

SEQ ID NO: 726458 - DNA, 25 bp, Artificial sequence
  Synthetic oligonucleotide
tcagcgccagcaggcgattgcgcca

SEQ ID NO: 726459 - DNA, 25 bp, Artificial sequence
  Synthetic oligonucleotide
tccagcccgcgcagggccagcagcg

SEQ ID NO: 726460 - DNA, 25 bp, Artificial sequence
  Synthetic oligonucleotide
ccagcaggcgattgcgccaaccggg

SEQ ID NO: 726461 - DNA, 25 bp, Artificial sequence
  Synthetic oligonucleotide
gcgcggttcttgtccagcccgcgca

SEQ ID NO: 726462 - DNA, 25 bp, Artificial sequence
  Synthetic oligonucleotide
atcagggcgcggttcttgtccagcc

SEQ ID NO: 726463 - DNA, 25 bp, Artificial sequence
  Synthetic oligonucleotide
gggacgatcagggcgcggttcttgt

SEQ ID NO: 726464 - DNA, 25 bp, Artificial sequence
  Synthetic oligonucleotide
caaccggggacgatcagggcgcggt

SEQ ID NO: 726465 - DNA, 25 bp, Artificial sequence
  Synthetic oligonucleotide
tgcgccaaccggggacgatcagggc

SEQ ID NO: 726466 - DNA, 25 bp, Artificial sequence
  Synthetic oligonucleotide
cttgctccggtcgagcctgccgagc

SEQ ID NO: 726467 - DNA, 25 bp, Artificial sequence
  Synthetic oligonucleotide
cgcgcagggccagcagcgcgacttc

SEQ ID NO: 726468 - DNA, 25 bp, Artificial sequence
  Synthetic oligonucleotide
aacagcacttccacgccgaaacgct

SEQ ID NO: 726469 - DNA, 25 bp, Artificial sequence
  Synthetic oligonucleotide
ggcggccaccgaggcgatattgagt

SEQ ID NO: 726470 - DNA, 25 bp, Artificial sequence
  Synthetic oligonucleotide
taggcgatgctctccagcgcgtcgc

SEQ ID NO: 726471 - DNA, 25 bp, Artificial sequence
  Synthetic oligonucleotide
agctcataggcgatgctctccagcg

SEQ ID NO: 726472 - DNA, 25 bp, Artificial sequence
  Synthetic oligonucleotide
tgcgccagctcataggcgatgctct

SEQ ID NO: 726473 - DNA, 25 bp, Artificial sequence
  Synthetic oligonucleotide
aaacgctgcgccagctcataggcga

SEQ ID NO: 726474 - DNA, 25 bp, Artificial sequence
  Synthetic oligonucleotide
tccagcgcgtcgcgctggcgcgcca

SEQ ID NO: 726475 - DNA, 25 bp, Artificial sequence
  Synthetic oligonucleotide
acttccacgccgaaacgctgcgcca

SEQ ID NO: 726476 - DNA, 25 bp, Artificial sequence
  Synthetic oligonucleotide
cgtcgcgctggcgcgccaccaggat

SEQ ID NO: 726477 - DNA, 25 bp, Artificial sequence
  Synthetic oligonucleotide
gtgcggaacagcacttccacgccga

SEQ ID NO: 726478 - DNA, 25 bp, Artificial sequence
  Synthetic oligonucleotide
tcgcaggtgcggaacagcacttcca

SEQ ID NO: 726479 - DNA, 25 bp, Artificial sequence
  Synthetic oligonucleotide
gaaagatcgcaggtgcggaacagca

SEQ ID NO: 726480 - DNA, 25 bp, Artificial sequence
  Synthetic oligonucleotide
ggctcggaaagatcgcaggtgcgga

SEQ ID NO: 726481 - DNA, 25 bp, Artificial sequence
  Synthetic oligonucleotide
tgcagcggctcggaaagatcgcagg

SEQ ID NO: 726482 - DNA, 25 bp, Artificial sequence
  Synthetic oligonucleotide
gacagttgcagcggctcggaaagat

SEQ ID NO: 726483 - DNA, 25 bp, Artificial sequence
  Synthetic oligonucleotide
acgccgaaacgctgcgccagctcat

SEQ ID NO: 726484 - DNA, 25 bp, Artificial sequence
  Synthetic oligonucleotide
cgggccagggcttcggctagggcca

SEQ ID NO: 726485 - DNA, 25 bp, Artificial sequence
  Synthetic oligonucleotide
gcgccggtgatcagggcataacggg

SEQ ID NO: 726486 - DNA, 25 bp, Artificial sequence
  Synthetic oligonucleotide
ctggaagcgccggtgatcagggcat

SEQ ID NO: 726487 - DNA, 25 bp, Artificial sequence
  Synthetic oligonucleotide
ataccgctggaagcgccggtgatca

SEQ ID NO: 726488 - DNA, 25 bp, Artificial sequence
  Synthetic oligonucleotide
ggccgataccgctggaagcgccggt

SEQ ID NO: 726489 - DNA, 25 bp, Artificial sequence
  Synthetic oligonucleotide
gggccaggccgataccgctggaagc

SEQ ID NO: 726490 - DNA, 25 bp, Artificial sequence
  Synthetic oligonucleotide
atgctctccagcgcgtcgcgctggc

SEQ ID NO: 726491 - DNA, 25 bp, Artificial sequence
  Synthetic oligonucleotide
agggcttcggctagggccaggccga

SEQ ID NO: 726492 - DNA, 25 bp, Artificial sequence
  Synthetic oligonucleotide
agttcgtgcaacaaccctgacagtt

SEQ ID NO: 726493 - DNA, 25 bp, Artificial sequence
  Synthetic oligonucleotide
ccgcgccgggccagggcttcggcta

SEQ ID NO: 726494 - DNA, 25 bp, Artificial sequence
  Synthetic oligonucleotide
gcgcgaccgcgccgggccagggctt

SEQ ID NO: 726495 - DNA, 25 bp, Artificial sequence
  Synthetic oligonucleotide
atcagggcgcgaccgcgccgggcca

SEQ ID NO: 726496 - DNA, 25 bp, Artificial sequence
  Synthetic oligonucleotide
accaggatcagggcgcgaccgcgcc

SEQ ID NO: 726497 - DNA, 25 bp, Artificial sequence
  Synthetic oligonucleotide
gcgccaccaggatcagggcgcgacc

SEQ ID NO: 726498 - DNA, 25 bp, Artificial sequence
  Synthetic oligonucleotide
gctggcgcgccaccaggatcagggc

SEQ ID NO: 726499 - DNA, 25 bp, Artificial sequence
  Synthetic oligonucleotide
cggctagggccaggccgataccgct

SEQ ID NO: 726500 - DNA, 25 bp, Artificial sequence
  Synthetic oligonucleotide
gcgccgagggagtggcaaaggcggg

SEQ ID NO: 726501 - DNA, 25 bp, Artificial sequence
  Synthetic oligonucleotide
agttcgatcagctcctgttcccgcg

SEQ ID NO: 726502 - DNA, 25 bp, Artificial sequence
  Synthetic oligonucleotide
tgttgagttcgatcagctcctgttc

SEQ ID NO: 726503 - DNA, 25 bp, Artificial sequence
  Synthetic oligonucleotide
ccaggatgttgagttcgatcagctc

SEQ ID NO: 726504 - DNA, 25 bp, Artificial sequence
  Synthetic oligonucleotide
ccagggccaggatgttgagttcgat

SEQ ID NO: 726505 - DNA, 25 bp, Artificial sequence
  Synthetic oligonucleotide
aggcgggccagggccaggatgttga

SEQ ID NO: 726506 - DNA, 25 bp, Artificial sequence
  Synthetic oligonucleotide
aaccctgacagttgcagcggctcgg

SEQ ID NO: 726507 - DNA, 25 bp, Artificial sequence
  Synthetic oligonucleotide
agggagtggcaaaggcgggccaggg

SEQ ID NO: 726508 - DNA, 25 bp, Artificial sequence
  Synthetic oligonucleotide
tcccgcgcccattcctggtcgatga

SEQ ID NO: 726509 - DNA, 25 bp, Artificial sequence
  Synthetic oligonucleotide
catgcgggcgccgagggagtggcaa

SEQ ID NO: 726510 - DNA, 25 bp, Artificial sequence
  Synthetic oligonucleotide
gtgccgccatgcgggcgccgaggga

SEQ ID NO: 726511 - DNA, 25 bp, Artificial sequence
  Synthetic oligonucleotide
gccctgtgccgccatgcgggcgccg

SEQ ID NO: 726512 - DNA, 25 bp, Artificial sequence
  Synthetic oligonucleotide
ggcccccgccctgtgccgccatgcg

SEQ ID NO: 726513 - DNA, 25 bp, Artificial sequence
  Synthetic oligonucleotide
gtatctggcccccgccctgtgccgc

SEQ ID NO: 726514 - DNA, 25 bp, Artificial sequence
  Synthetic oligonucleotide
tattgagtatctggcccccgccctg

SEQ ID NO: 726515 - DNA, 25 bp, Artificial sequence
  Synthetic oligonucleotide
tggcaaaggcgggccagggccagga

SEQ ID NO: 726516 - DNA, 25 bp, Artificial sequence
  Synthetic oligonucleotide
atcccggcattgttaaccagcaggt

SEQ ID NO: 726517 - DNA, 25 bp, Artificial sequence
  Synthetic oligonucleotide
cagactgagccaacggcgaaccttg

SEQ ID NO: 726518 - DNA, 25 bp, Artificial sequence
  Synthetic oligonucleotide
tgttccagttcgtgcaacaaccctg

SEQ ID NO: 726519 - DNA, 25 bp, Artificial sequence
  Synthetic oligonucleotide
tcgccctgttccagttcgtgcaaca

SEQ ID NO: 726520 - DNA, 25 bp, Artificial sequence
  Synthetic oligonucleotide
tgtcgttcgccctgttccagttcgt

SEQ ID NO: 726521 - DNA, 25 bp, Artificial sequence
  Synthetic oligonucleotide
tcgatctgtcgttcgccctgttcca

SEQ ID NO: 726522 - DNA, 25 bp, Artificial sequence
  Synthetic oligonucleotide
agcaggtcgatctgtcgttcgccct

SEQ ID NO: 726523 - DNA, 25 bp, Artificial sequence
  Synthetic oligonucleotide
atcagctcctgttcccgcgcccatt

SEQ ID NO: 726524 - DNA, 25 bp, Artificial sequence
  Synthetic oligonucleotide
gcattgttaaccagcaggtcgatct

SEQ ID NO: 726525 - DNA, 25 bp, Artificial sequence
  Synthetic oligonucleotide
tcctgttcccgcgcccattcctggt

SEQ ID NO: 726526 - DNA, 25 bp, Artificial sequence
  Synthetic oligonucleotide
gtaccgatcccggcattgttaacca

SEQ ID NO: 726527 - DNA, 25 bp, Artificial sequence
  Synthetic oligonucleotide
gccggaggtaccgatcccggcattg

SEQ ID NO: 726528 - DNA, 25 bp, Artificial sequence
  Synthetic oligonucleotide
tcgatgaaggggccggaggtaccga

SEQ ID NO: 726529 - DNA, 25 bp, Artificial sequence
  Synthetic oligonucleotide
tcctggtcgatgaaggggccggagg

SEQ ID NO: 726530 - DNA, 25 bp, Artificial sequence
  Synthetic oligonucleotide
gcccattcctggtcgatgaaggggc

SEQ ID NO: 726531 - DNA, 25 bp, Artificial sequence
  Synthetic oligonucleotide
tgcaacaaccctgacagttgcagcg

SEQ ID NO: 726532 - DNA, 25 bp, Artificial sequence
  Synthetic oligonucleotide
ttaaccagcaggtcgatctgtcgtt

SEQ ID NO: 726533 - DNA, 25 bp, Artificial sequence
  Synthetic oligonucleotide
cgagcgcaacctgcgcgaggcgctg

SEQ ID NO: 726534 - DNA, 25 bp, Artificial sequence
  Synthetic oligonucleotide
acggcgaaccttgccgccctgcgag

SEQ ID NO: 726535 - DNA, 25 bp, Artificial sequence
  Synthetic oligonucleotide
gaacagatggcgccctgcgtgctgt

SEQ ID NO: 726536 - DNA, 25 bp, Artificial sequence
  Synthetic oligonucleotide
ctggccgaacagatggcgccctgcg

SEQ ID NO: 726537 - DNA, 25 bp, Artificial sequence
  Synthetic oligonucleotide
tgcgcctggccgaacagatggcgcc

SEQ ID NO: 726538 - DNA, 25 bp, Artificial sequence
  Synthetic oligonucleotide
ggcgctgcgcctggccgaacagatg

SEQ ID NO: 726539 - DNA, 25 bp, Artificial sequence
  Synthetic oligonucleotide
ccctgcgtgctgtggatggatgaag

SEQ ID NO: 726540 - DNA, 25 bp, Artificial sequence
  Synthetic oligonucleotide
caacctgcgcgaggcgctgcgcctg

SEQ ID NO: 726541 - DNA, 25 bp, Artificial sequence
  Synthetic oligonucleotide
gtgctgtggatggatgaagtggaga

SEQ ID NO: 726542 - DNA, 25 bp, Artificial sequence
  Synthetic oligonucleotide
cgaaaccgagcgcaacctgcgcgag

SEQ ID NO: 726543 - DNA, 25 bp, Artificial sequence
  Synthetic oligonucleotide
acttcggcgaaaccgagcgcaacct

SEQ ID NO: 726544 - DNA, 25 bp, Artificial sequence
  Synthetic oligonucleotide
acaagtacttcggcgaaaccgagcg

SEQ ID NO: 726545 - DNA, 25 bp, Artificial sequence
  Synthetic oligonucleotide
tctacaacaagtacttcggcgaaac

SEQ ID NO: 726546 - DNA, 25 bp, Artificial sequence
  Synthetic oligonucleotide
ctgtctctacaacaagtacttcggc

SEQ ID NO: 726547 - DNA, 25 bp, Artificial sequence
  Synthetic oligonucleotide
ttcgcctgtctctacaacaagtact

SEQ ID NO: 726548 - DNA, 25 bp, Artificial sequence
  Synthetic oligonucleotide
tgcgcgaggcgctgcgcctggccga

SEQ ID NO: 726549 - DNA, 25 bp, Artificial sequence
  Synthetic oligonucleotide
gaccaggacaacggcgtcagtcagc

SEQ ID NO: 726550 - DNA, 25 bp, Artificial sequence
  Synthetic oligonucleotide
ctgacctggatggccgagcgcgagg

SEQ ID NO: 726551 - DNA, 25 bp, Artificial sequence
  Synthetic oligonucleotide
taccctgctgacctggatggccgag

SEQ ID NO: 726552 - DNA, 25 bp, Artificial sequence
  Synthetic oligonucleotide
gctgggtaccctgctgacctggatg

SEQ ID NO: 726553 - DNA, 25 bp, Artificial sequence
  Synthetic oligonucleotide
gcgcgtgctgggtaccctgctgacc

SEQ ID NO: 726554 - DNA, 25 bp, Artificial sequence
  Synthetic oligonucleotide
cagtcagcgcgtgctgggtaccctg

SEQ ID NO: 726555 - DNA, 25 bp, Artificial sequence
  Synthetic oligonucleotide
atggcgccctgcgtgctgtggatgg

SEQ ID NO: 726556 - DNA, 25 bp, Artificial sequence
  Synthetic oligonucleotide
gacaacggcgtcagtcagcgcgtgc

SEQ ID NO: 726557 - DNA, 25 bp, Artificial sequence
  Synthetic oligonucleotide
cgttgctgcgtctggatttcgcctg

SEQ ID NO: 726558 - DNA, 25 bp, Artificial sequence
  Synthetic oligonucleotide
ggcggcgaccaggacaacggcgtca

SEQ ID NO: 726559 - DNA, 25 bp, Artificial sequence
  Synthetic oligonucleotide
atttctggcggcgaccaggacaacg

SEQ ID NO: 726560 - DNA, 25 bp, Artificial sequence
  Synthetic oligonucleotide
gaagggcatttctggcggcgaccag

SEQ ID NO: 726561 - DNA, 25 bp, Artificial sequence
  Synthetic oligonucleotide
agtggagaagggcatttctggcggc

SEQ ID NO: 726562 - DNA, 25 bp, Artificial sequence
  Synthetic oligonucleotide
gatgaagtggagaagggcatttctg

SEQ ID NO: 726563 - DNA, 25 bp, Artificial sequence
  Synthetic oligonucleotide
tggatggatgaagtggagaagggca

SEQ ID NO: 726564 - DNA, 25 bp, Artificial sequence
  Synthetic oligonucleotide
ggcgtcagtcagcgcgtgctgggta

SEQ ID NO: 726565 - DNA, 25 bp, Artificial sequence
  Synthetic oligonucleotide
gggcttgccgcgctcaagcgctggc

SEQ ID NO: 726566 - DNA, 25 bp, Artificial sequence
  Synthetic oligonucleotide
gttcctcgccggcaagcctggcgac

SEQ ID NO: 726567 - DNA, 25 bp, Artificial sequence
  Synthetic oligonucleotide
gtcggcgttcctcgccggcaagcct

SEQ ID NO: 726568 - DNA, 25 bp, Artificial sequence
  Synthetic oligonucleotide
gcgtcagtcggcgttcctcgccggc

SEQ ID NO: 726569 - DNA, 25 bp, Artificial sequence
  Synthetic oligonucleotide
tcggcgagcgtcagtcggcgttcct

SEQ ID NO: 726570 - DNA, 25 bp, Artificial sequence
  Synthetic oligonucleotide
ctggctcggcgagcgtcagtcggcg

SEQ ID NO: 726571 - DNA, 25 bp, Artificial sequence
  Synthetic oligonucleotide
ctggatttcgcctgtctctacaaca

SEQ ID NO: 726572 - DNA, 25 bp, Artificial sequence
  Synthetic oligonucleotide
ccgcgctcaagcgctggctcggcga

SEQ ID NO: 726573 - DNA, 25 bp, Artificial sequence
  Synthetic oligonucleotide
tggcgaccagccgaagggcatgatg

SEQ ID NO: 726574 - DNA, 25 bp, Artificial sequence
  Synthetic oligonucleotide
ggtcggcgggcttgccgcgctcaag

SEQ ID NO: 726575 - DNA, 25 bp, Artificial sequence
  Synthetic oligonucleotide
gccgaggtcggcgggcttgccgcgc

SEQ ID NO: 726576 - DNA, 25 bp, Artificial sequence
  Synthetic oligonucleotide
cgcttcgccgaggtcggcgggcttg

SEQ ID NO: 726577 - DNA, 25 bp, Artificial sequence
  Synthetic oligonucleotide
accgcgcgcttcgccgaggtcggcg

SEQ ID NO: 726578 - DNA, 25 bp, Artificial sequence
  Synthetic oligonucleotide
tacgacaccgcgcgcttcgccgagg

SEQ ID NO: 726579 - DNA, 25 bp, Artificial sequence
  Synthetic oligonucleotide
gcggagggtaccgccgaggcgttga

SEQ ID NO: 726580 - DNA, 25 bp, Artificial sequence
  Synthetic oligonucleotide
tcaagcgctggctcggcgagcgtca

SEQ ID NO: 726581 - DNA, 25 bp, Artificial sequence
  Synthetic oligonucleotide
ccggcaagagcctggcggccaaggc

SEQ ID NO: 726582 - DNA, 25 bp, Artificial sequence
  Synthetic oligonucleotide
cgcgaggcgccggtcttcatggtcg

SEQ ID NO: 726583 - DNA, 25 bp, Artificial sequence
  Synthetic oligonucleotide
gcttgccgttgctgcgtctggattt

SEQ ID NO: 726584 - DNA, 25 bp, Artificial sequence
  Synthetic oligonucleotide
tctggggcttgccgttgctgcgtct

SEQ ID NO: 726585 - DNA, 25 bp, Artificial sequence
  Synthetic oligonucleotide
ccggcctctggggcttgccgttgct

SEQ ID NO: 726586 - DNA, 25 bp, Artificial sequence
  Synthetic oligonucleotide
gcggtggccggcctctggggcttgc

SEQ ID NO: 726587 - DNA, 25 bp, Artificial sequence
  Synthetic oligonucleotide
gccaaggcggtggccggcctctggg

SEQ ID NO: 726588 - DNA, 25 bp, Artificial sequence
  Synthetic oligonucleotide
cgccggcaagcctggcgaccagccg

SEQ ID NO: 726589 - DNA, 25 bp, Artificial sequence
  Synthetic oligonucleotide
agagcctggcggccaaggcggtggc

SEQ ID NO: 726590 - DNA, 25 bp, Artificial sequence
  Synthetic oligonucleotide
caagcctggcgaccagccgaagggc

SEQ ID NO: 726591 - DNA, 25 bp, Artificial sequence
  Synthetic oligonucleotide
agggcgccggcaagagcctggcggc

SEQ ID NO: 726592 - DNA, 25 bp, Artificial sequence
  Synthetic oligonucleotide
gcgtgcagggcgccggcaagagcct

SEQ ID NO: 726593 - DNA, 25 bp, Artificial sequence
  Synthetic oligonucleotide
tggtcggcgtgcagggcgccggcaa

SEQ ID NO: 726594 - DNA, 25 bp, Artificial sequence
  Synthetic oligonucleotide
aagggcatgatgctggtcggcgtgc

SEQ ID NO: 726595 - DNA, 25 bp, Artificial sequence
  Synthetic oligonucleotide
cagccgaagggcatgatgctggtcg

SEQ ID NO: 726596 - DNA, 25 bp, Artificial sequence
  Synthetic oligonucleotide
tgcgtctggatttcgcctgtctcta

SEQ ID NO: 726597 - DNA, 25 bp, Artificial sequence
  Synthetic oligonucleotide
tggcggccaaggcggtggccggcct

SEQ ID NO: 726598 - DNA, 25 bp, Artificial sequence
  Synthetic oligonucleotide
cggtggtggcggcactgtacgccgg

SEQ ID NO: 726599 - DNA, 25 bp, Artificial sequence
  Synthetic oligonucleotide
gcggtggatcaggatctgttgctca

SEQ ID NO: 726600 - DNA, 25 bp, Artificial sequence
  Synthetic oligonucleotide
acagcaggcggtggatcaggatctg

SEQ ID NO: 726601 - DNA, 25 bp, Artificial sequence
  Synthetic oligonucleotide
ggcgcgacagcaggcggtggatcag

SEQ ID NO: 726602 - DNA, 25 bp, Artificial sequence
  Synthetic oligonucleotide
cgggcaggcgcgacagcaggcggtg

SEQ ID NO: 726603 - DNA, 25 bp, Artificial sequence
  Synthetic oligonucleotide
gtacgccgggcaggcgcgacagcag

SEQ ID NO: 726604 - DNA, 25 bp, Artificial sequence
  Synthetic oligonucleotide
cggctgccagcgagggtttcagcgg

SEQ ID NO: 726605 - DNA, 25 bp, Artificial sequence
  Synthetic oligonucleotide
tggcggcactgtacgccgggcaggc

SEQ ID NO: 726606 - DNA, 25 bp, Artificial sequence
  Synthetic oligonucleotide
ttgctcagggaactggcgcgaacct

SEQ ID NO: 726607 - DNA, 25 bp, Artificial sequence
  Synthetic oligonucleotide
agcaggcggtggtggcggcactgta

SEQ ID NO: 726608 - DNA, 25 bp, Artificial sequence
  Synthetic oligonucleotide
agatcgagcaggcggtggtggcggc

SEQ ID NO: 726609 - DNA, 25 bp, Artificial sequence
  Synthetic oligonucleotide
gggcggagatcgagcaggcggtggt

SEQ ID NO: 726610 - DNA, 25 bp, Artificial sequence
  Synthetic oligonucleotide
tcagcggggcggagatcgagcaggc

SEQ ID NO: 726611 - DNA, 25 bp, Artificial sequence
  Synthetic oligonucleotide
agggtttcagcggggcggagatcga

SEQ ID NO: 726612 - DNA, 25 bp, Artificial sequence
  Synthetic oligonucleotide
tggatggccgagcgcgaggcgccgg

SEQ ID NO: 726613 - DNA, 25 bp, Artificial sequence
  Synthetic oligonucleotide
gcactgtacgccgggcaggcgcgac

SEQ ID NO: 726614 - DNA, 25 bp, Artificial sequence
  Synthetic oligonucleotide
tgctgatggcggaaaagctcgccgc

SEQ ID NO: 726615 - DNA, 25 bp, Artificial sequence
  Synthetic oligonucleotide
tgagcttcgagtacgacaccgcgcg

SEQ ID NO: 726616 - DNA, 25 bp, Artificial sequence
  Synthetic oligonucleotide
taccggcagactgagccaacggcga

SEQ ID NO: 726617 - DNA, 25 bp, Artificial sequence
  Synthetic oligonucleotide
gggcggtaccggcagactgagccaa

SEQ ID NO: 726618 - DNA, 25 bp, Artificial sequence
  Synthetic oligonucleotide
aggggcgggcggtaccggcagactg

SEQ ID NO: 726619 - DNA, 25 bp, Artificial sequence
  Synthetic oligonucleotide
cgctgcggacctgggccaaggggcg

SEQ ID NO: 726620 - DNA, 25 bp, Artificial sequence
  Synthetic oligonucleotide
tcgccgcgctgcggacctgggccaa

SEQ ID NO: 726621 - DNA, 25 bp, Artificial sequence
  Synthetic oligonucleotide
gatcaggatctgttgctcagggaac

SEQ ID NO: 726622 - DNA, 25 bp, Artificial sequence
  Synthetic oligonucleotide
tggcggaaaagctcgccgcgctgcg

SEQ ID NO: 726623 - DNA, 25 bp, Artificial sequence
  Synthetic oligonucleotide
gatctgttgctcagggaactggcgc

SEQ ID NO: 726624 - DNA, 25 bp, Artificial sequence
  Synthetic oligonucleotide
tgtcggtgctgatggcggaaaagct

SEQ ID NO: 726625 - DNA, 25 bp, Artificial sequence
  Synthetic oligonucleotide
cgccgctgtcggtgctgatggcgga

SEQ ID NO: 726626 - DNA, 25 bp, Artificial sequence
  Synthetic oligonucleotide
gaacctcgccgctgtcggtgctgat

SEQ ID NO: 726627 - DNA, 25 bp, Artificial sequence
  Synthetic oligonucleotide
tggcgcgaacctcgccgctgtcggt

SEQ ID NO: 726628 - DNA, 25 bp, Artificial sequence
  Synthetic oligonucleotide
gggaactggcgcgaacctcgccgct

SEQ ID NO: 726629 - DNA, 25 bp, Artificial sequence
  Synthetic oligonucleotide
ctgctggcggctgccagcgagggtt

SEQ ID NO: 726630 - DNA, 25 bp, Artificial sequence
  Synthetic oligonucleotide
aaaagctcgccgcgctgcggacctg

SEQ ID NO: 726631 - DNA, 25 bp, Artificial sequence
  Synthetic oligonucleotide
ctatcgaccgcctgccgcccgaact

SEQ ID NO: 726632 - DNA, 25 bp, Artificial sequence
  Synthetic oligonucleotide
tcgacgaattgttcttcgtcgacct

SEQ ID NO: 726633 - DNA, 25 bp, Artificial sequence
  Synthetic oligonucleotide
gacgcttcgacgaattgttcttcgt

SEQ ID NO: 726634 - DNA, 25 bp, Artificial sequence
  Synthetic oligonucleotide
gcaagggacgcttcgacgaattgtt

SEQ ID NO: 726635 - DNA, 25 bp, Artificial sequence
  Synthetic oligonucleotide
tgatccgcaagggacgcttcgacga

SEQ ID NO: 726636 - DNA, 25 bp, Artificial sequence
  Synthetic oligonucleotide
ccgaactgatccgcaagggacgctt

SEQ ID NO: 726637 - DNA, 25 bp, Artificial sequence
  Synthetic oligonucleotide
ccagcgagggtttcagcggggcgga

SEQ ID NO: 726638 - DNA, 25 bp, Artificial sequence
  Synthetic oligonucleotide
accgcctgccgcccgaactgatccg

SEQ ID NO: 726639 - DNA, 25 bp, Artificial sequence
  Synthetic oligonucleotide
gtcgacctgccgacgccggaggttc

SEQ ID NO: 726640 - DNA, 25 bp, Artificial sequence
  Synthetic oligonucleotide
cgaacgctatcgaccgcctgccgcc

SEQ ID NO: 726641 - DNA, 25 bp, Artificial sequence
  Synthetic oligonucleotide
ccaccgcgaacgctatcgaccgcct

SEQ ID NO: 726642 - DNA, 25 bp, Artificial sequence
  Synthetic oligonucleotide
tggtcgccaccgcgaacgctatcga

SEQ ID NO: 726643 - DNA, 25 bp, Artificial sequence
  Synthetic oligonucleotide
tcttcatggtcgccaccgcgaacgc

SEQ ID NO: 726644 - DNA, 25 bp, Artificial sequence
  Synthetic oligonucleotide
gcgccggtcttcatggtcgccaccg

SEQ ID NO: 726645 - DNA, 25 bp, Artificial sequence
  Synthetic oligonucleotide
gagccaacggcgaaccttgccgccc

SEQ ID NO: 726646 - DNA, 25 bp, Artificial sequence
  Synthetic oligonucleotide
tgccgcccgaactgatccgcaaggg

SEQ ID NO: 726647 - DNA, 25 bp, Artificial sequence
  Synthetic oligonucleotide
tccgcatccacctgcaacgccgcga

SEQ ID NO: 726648 - DNA, 25 bp, Artificial sequence
  Synthetic oligonucleotide
ctccatctgctggcggctgccagcg

SEQ ID NO: 726649 - DNA, 25 bp, Artificial sequence
  Synthetic oligonucleotide
ttcgacctccatctgctggcggctg

SEQ ID NO: 726650 - DNA, 25 bp, Artificial sequence
  Synthetic oligonucleotide
gcacagttcgacctccatctgctgg

SEQ ID NO: 726651 - DNA, 25 bp, Artificial sequence
  Synthetic oligonucleotide
agccggcacagttcgacctccatct

SEQ ID NO: 726652 - DNA, 25 bp, Artificial sequence
  Synthetic oligonucleotide
agctggagccggcacagttcgacct

SEQ ID NO: 726653 - DNA, 25 bp, Artificial sequence
  Synthetic oligonucleotide
gccgcgagctggagccggcacagtt

SEQ ID NO: 726654 - DNA, 25 bp, Artificial sequence
  Synthetic oligonucleotide
aattgttcttcgtcgacctgccgac

SEQ ID NO: 726655 - DNA, 25 bp, Artificial sequence
  Synthetic oligonucleotide
atccacctgcaacgccgcgagctgg

SEQ ID NO: 726656 - DNA, 25 bp, Artificial sequence
  Synthetic oligonucleotide
tcttcgtcgacctgccgacgccgga

SEQ ID NO: 726657 - DNA, 25 bp, Artificial sequence
  Synthetic oligonucleotide
agatcttccgcatccacctgcaacg

SEQ ID NO: 726658 - DNA, 25 bp, Artificial sequence
  Synthetic oligonucleotide
gcgccgagatcttccgcatccacct

SEQ ID NO: 726659 - DNA, 25 bp, Artificial sequence
  Synthetic oligonucleotide
aggttcgcgccgagatcttccgcat

SEQ ID NO: 726660 - DNA, 25 bp, Artificial sequence
  Synthetic oligonucleotide
cgccggaggttcgcgccgagatctt

SEQ ID NO: 726661 - DNA, 25 bp, Artificial sequence
  Synthetic oligonucleotide
tgccgacgccggaggttcgcgccga

SEQ ID NO: 726662 - DNA, 25 bp, Artificial sequence
  Synthetic oligonucleotide
gccgagcgcgaggcgccggtcttca

SEQ ID NO: 726663 - DNA, 25 bp, Artificial sequence
  Synthetic oligonucleotide
tgcaacgccgcgagctggagccggc

SEQ ID NO: 726664 - DNA, 25 bp, Artificial sequence
  Synthetic oligonucleotide
tgcctgacgtacaaggcgatgtttt

SEQ ID NO: 726665 - DNA, 25 bp, Artificial sequence
  Synthetic oligonucleotide
aggtcgatgtgattttgcgacgcag

SEQ ID NO: 726666 - DNA, 25 bp, Artificial sequence
  Synthetic oligonucleotide
tatggagagacctgccagggcccgg

SEQ ID NO: 726667 - DNA, 25 bp, Artificial sequence
  Synthetic oligonucleotide
agttcttatggagagacctgccagg

SEQ ID NO: 726668 - DNA, 25 bp, Artificial sequence
  Synthetic oligonucleotide
tttttgagttcttatggagagacct

SEQ ID NO: 726669 - DNA, 25 bp, Artificial sequence
  Synthetic oligonucleotide
gatgtttttttgagttcttatggag

SEQ ID NO: 726670 - DNA, 25 bp, Artificial sequence
  Synthetic oligonucleotide
tgccagggcccgggagctcagcgga

SEQ ID NO: 726671 - DNA, 25 bp, Artificial sequence
  Synthetic oligonucleotide
acgtacaaggcgatgtttttttgag

SEQ ID NO: 726672 - DNA, 25 bp, Artificial sequence
  Synthetic oligonucleotide
ggcccgggagctcagcggagagctc

SEQ ID NO: 726673 - DNA, 25 bp, Artificial sequence
  Synthetic oligonucleotide
agaatatgcctgacgtacaaggcga

SEQ ID NO: 726674 - DNA, 25 bp, Artificial sequence
  Synthetic oligonucleotide
gaataaagaatatgcctgacgtaca

SEQ ID NO: 726675 - DNA, 25 bp, Artificial sequence
  Synthetic oligonucleotide
ccgaaagaataaagaatatgcctga

SEQ ID NO: 726676 - DNA, 25 bp, Artificial sequence
  Synthetic oligonucleotide
cgagtcccgaaagaataaagaatat

SEQ ID NO: 726677 - DNA, 25 bp, Artificial sequence
  Synthetic oligonucleotide
ccatgcccgagtcccgaaagaataa

SEQ ID NO: 726678 - DNA, 25 bp, Artificial sequence
  Synthetic oligonucleotide
atagctaccatgcccgagtcccgaa

SEQ ID NO: 726679 - DNA, 25 bp, Artificial sequence
  Synthetic oligonucleotide
caaggcgatgtttttttgagttctt

SEQ ID NO: 726680 - DNA, 25 bp, Artificial sequence
  Synthetic oligonucleotide
aggaagtgtgccagtaaaccgcgtc

SEQ ID NO: 726681 - DNA, 25 bp, Artificial sequence
  Synthetic oligonucleotide
aagaaatcaccgctgttgaggtagc

SEQ ID NO: 726682 - DNA, 25 bp, Artificial sequence
  Synthetic oligonucleotide
gacggaccatgaaggtcgatgtgat

SEQ ID NO: 726683 - DNA, 25 bp, Artificial sequence
  Synthetic oligonucleotide
ttaacagacggaccatgaaggtcga

SEQ ID NO: 726684 - DNA, 25 bp, Artificial sequence
  Synthetic oligonucleotide
tccagcttaacagacggaccatgaa

SEQ ID NO: 726685 - DNA, 25 bp, Artificial sequence
  Synthetic oligonucleotide
accgcgtccagcttaacagacggac

SEQ ID NO: 726686 - DNA, 25 bp, Artificial sequence
  Synthetic oligonucleotide
agagacctgccagggcccgggagct

SEQ ID NO: 726687 - DNA, 25 bp, Artificial sequence
  Synthetic oligonucleotide
tgtgccagtaaaccgcgtccagctt

SEQ ID NO: 726688 - DNA, 25 bp, Artificial sequence
  Synthetic oligonucleotide
gagtttgggtgtgtgggtaatagct

SEQ ID NO: 726689 - DNA, 25 bp, Artificial sequence
  Synthetic oligonucleotide
cagatcaggaagtgtgccagtaaac

SEQ ID NO: 726690 - DNA, 25 bp, Artificial sequence
  Synthetic oligonucleotide
accgggcagatcaggaagtgtgcca

SEQ ID NO: 726691 - DNA, 25 bp, Artificial sequence
  Synthetic oligonucleotide
cccccaaccgggcagatcaggaagt

SEQ ID NO: 726692 - DNA, 25 bp, Artificial sequence
  Synthetic oligonucleotide
agagctccccccaaccgggcagatc

SEQ ID NO: 726693 - DNA, 25 bp, Artificial sequence
  Synthetic oligonucleotide
cagcggagagctccccccaaccggg

SEQ ID NO: 726694 - DNA, 25 bp, Artificial sequence
  Synthetic oligonucleotide
gagctcagcggagagctccccccaa

SEQ ID NO: 726695 - DNA, 25 bp, Artificial sequence
  Synthetic oligonucleotide
agtaaaccgcgtccagcttaacaga

SEQ ID NO: 726696 - DNA, 25 bp, Artificial sequence
  Synthetic oligonucleotide
ggccgtcgtcgtcctcgatgaggat

SEQ ID NO: 726697 - DNA, 25 bp, Artificial sequence
  Synthetic oligonucleotide
gatgaagaacagcgtttcgcagcga

SEQ ID NO: 726698 - DNA, 25 bp, Artificial sequence
  Synthetic oligonucleotide
cttgatgatgaagaacagcgtttcg

SEQ ID NO: 726699 - DNA, 25 bp, Artificial sequence
  Synthetic oligonucleotide
cgaacccttgatgatgaagaacagc

SEQ ID NO: 726700 - DNA, 25 bp, Artificial sequence
  Synthetic oligonucleotide
ggtgaccgaacccttgatgatgaag

SEQ ID NO: 726701 - DNA, 25 bp, Artificial sequence
  Synthetic oligonucleotide
tgaggatggtgaccgaacccttgat

SEQ ID NO: 726702 - DNA, 25 bp, Artificial sequence
  Synthetic oligonucleotide
tgggtaatagctaccatgcccgagt

SEQ ID NO: 726703 - DNA, 25 bp, Artificial sequence
  Synthetic oligonucleotide
cgtcgtcctcgatgaggatggtgac

SEQ ID NO: 726704 - DNA, 25 bp, Artificial sequence
  Synthetic oligonucleotide
gcagcgatcgccggcatagatgatg

SEQ ID NO: 726705 - DNA, 25 bp, Artificial sequence
  Synthetic oligonucleotide
tttcgcggccgtcgtcgtcctcgat

SEQ ID NO: 726706 - DNA, 25 bp, Artificial sequence
  Synthetic oligonucleotide
tgatcatttcgcggccgtcgtcgtc

SEQ ID NO: 726707 - DNA, 25 bp, Artificial sequence
  Synthetic oligonucleotide
gccgatgatcatttcgcggccgtcg

SEQ ID NO: 726708 - DNA, 25 bp, Artificial sequence
  Synthetic oligonucleotide
gaggtagccgatgatcatttcgcgg

SEQ ID NO: 726709 - DNA, 25 bp, Artificial sequence
  Synthetic oligonucleotide
gctgttgaggtagccgatgatcatt

SEQ ID NO: 726710 - DNA, 25 bp, Artificial sequence
  Synthetic oligonucleotide
agggccgcggtctcaaggaggccca

SEQ ID NO: 726711 - DNA, 25 bp, Artificial sequence
  Synthetic oligonucleotide
cctcgatgaggatggtgaccgaacc

SEQ ID NO: 726712 - DNA, 25 bp, Artificial sequence
  Synthetic oligonucleotide
ggtgtagcggcggcggtgacagtgt

SEQ ID NO: 726713 - DNA, 25 bp, Artificial sequence
  Synthetic oligonucleotide
atgtgattttgcgacgcagctatca

SEQ ID NO: 726714 - DNA, 25 bp, Artificial sequence
  Synthetic oligonucleotide
gtgtttgagtttgggtgtgtgggta

SEQ ID NO: 726715 - DNA, 25 bp, Artificial sequence
  Synthetic oligonucleotide
tctaggtgtttgagtttgggtgtgt

SEQ ID NO: 726716 - DNA, 25 bp, Artificial sequence
  Synthetic oligonucleotide
agcttgtctaggtgtttgagtttgg

SEQ ID NO: 726717 - DNA, 25 bp, Artificial sequence
  Synthetic oligonucleotide
gcgagcagcttgtctaggtgtttga

SEQ ID NO: 726718 - DNA, 25 bp, Artificial sequence
  Synthetic oligonucleotide
cagtgtgcgagcagcttgtctaggt

SEQ ID NO: 726719 - DNA, 25 bp, Artificial sequence
  Synthetic oligonucleotide
gaacagcgtttcgcagcgatcgccg

SEQ ID NO: 726720 - DNA, 25 bp, Artificial sequence
  Synthetic oligonucleotide
gcggcggcggtgacagtgtgcgagc

SEQ ID NO: 726721 - DNA, 25 bp, Artificial sequence
  Synthetic oligonucleotide
cgtttcgcagcgatcgccggcatag

SEQ ID NO: 726722 - DNA, 25 bp, Artificial sequence
  Synthetic oligonucleotide
ctttgcggtgtagcggcggcggtga

SEQ ID NO: 726723 - DNA, 25 bp, Artificial sequence
  Synthetic oligonucleotide
gtgctctttgcggtgtagcggcggc

SEQ ID NO: 726724 - DNA, 25 bp, Artificial sequence
  Synthetic oligonucleotide
atgatggtgctctttgcggtgtagc

SEQ ID NO: 726725 - DNA, 25 bp, Artificial sequence
  Synthetic oligonucleotide
ggcatagatgatggtgctctttgcg

SEQ ID NO: 726726 - DNA, 25 bp, Artificial sequence
  Synthetic oligonucleotide
atcgccggcatagatgatggtgctc

SEQ ID NO: 726727 - DNA, 25 bp, Artificial sequence
  Synthetic oligonucleotide
ggtgtgtgggtaatagctaccatgc

SEQ ID NO: 726728 - DNA, 25 bp, Artificial sequence
  Synthetic oligonucleotide
gcggtgacagtgtgcgagcagcttg

SEQ ID NO: 726729 - DNA, 25 bp, Artificial sequence
  Synthetic oligonucleotide
ggcggctgcaccaacttcgatgtgg

SEQ ID NO: 726730 - DNA, 25 bp, Artificial sequence
  Synthetic oligonucleotide
ccatgaaggtcgatgtgattttgcg

SEQ ID NO: 726731 - DNA, 25 bp, Artificial sequence
  Synthetic oligonucleotide
aagaaggcgcgccagccggtggaga

SEQ ID NO: 726732 - DNA, 25 bp, Artificial sequence
  Synthetic oligonucleotide
atcctgaagaaggcgcgccagccgg

SEQ ID NO: 726733 - DNA, 25 bp, Artificial sequence
  Synthetic oligonucleotide
gtcagcatcctgaagaaggcgcgcc

SEQ ID NO: 726734 - DNA, 25 bp, Artificial sequence
  Synthetic oligonucleotide
gatgtggtcagcatcctgaagaagg

SEQ ID NO: 726735 - DNA, 25 bp, Artificial sequence
  Synthetic oligonucleotide
cagccggtggagagctgcgaagcct

SEQ ID NO: 726736 - DNA, 25 bp, Artificial sequence
  Synthetic oligonucleotide
tgcaccaacttcgatgtggtcagca

SEQ ID NO: 726737 - DNA, 25 bp, Artificial sequence
  Synthetic oligonucleotide
gtggagagctgcgaagccttcctcg

SEQ ID NO: 726738 - DNA, 25 bp, Artificial sequence
  Synthetic oligonucleotide
ggcctcggcggctgcaccaacttcg

SEQ ID NO: 726739 - DNA, 25 bp, Artificial sequence
  Synthetic oligonucleotide
ctgatcggcctcggcggctgcacca

SEQ ID NO: 726740 - DNA, 25 bp, Artificial sequence
  Synthetic oligonucleotide
atggtcctgatcggcctcggcggct

SEQ ID NO: 726741 - DNA, 25 bp, Artificial sequence
  Synthetic oligonucleotide
tggagatggtcctgatcggcctcgg

SEQ ID NO: 726742 - DNA, 25 bp, Artificial sequence
  Synthetic oligonucleotide
gccctatggagatggtcctgatcgg

SEQ ID NO: 726743 - DNA, 25 bp, Artificial sequence
  Synthetic oligonucleotide
gggtgcgccctatggagatggtcct

SEQ ID NO: 726744 - DNA, 25 bp, Artificial sequence
  Synthetic oligonucleotide
aacttcgatgtggtcagcatcctga

SEQ ID NO: 726745 - DNA, 25 bp, Artificial sequence
  Synthetic oligonucleotide
cgaggagcccaaggtgttcacgaag

SEQ ID NO: 726746 - DNA, 25 bp, Artificial sequence
  Synthetic oligonucleotide
tggtcaagggccgcggtctcaagga

SEQ ID NO: 726747 - DNA, 25 bp, Artificial sequence
  Synthetic oligonucleotide
cttcgtggtcaagggccgcggtctc

SEQ ID NO: 726748 - DNA, 25 bp, Artificial sequence
  Synthetic oligonucleotide
cgtgcacttcgtggtcaagggccgc

SEQ ID NO: 726749 - DNA, 25 bp, Artificial sequence
  Synthetic oligonucleotide
gatccacgtgcacttcgtggtcaag

SEQ ID NO: 726750 - DNA, 25 bp, Artificial sequence
  Synthetic oligonucleotide
cacgaagatccacgtgcacttcgtg

SEQ ID NO: 726751 - DNA, 25 bp, Artificial sequence
  Synthetic oligonucleotide
gcgcgccagccggtggagagctgcg

SEQ ID NO: 726752 - DNA, 25 bp, Artificial sequence
  Synthetic oligonucleotide
gcccaaggtgttcacgaagatccac

SEQ ID NO: 726753 - DNA, 25 bp, Artificial sequence
  Synthetic oligonucleotide
atggcggacgcaacctcggggtgcg

SEQ ID NO: 726754 - DNA, 25 bp, Artificial sequence
  Synthetic oligonucleotide
ggccgacgaggagcccaaggtgttc

SEQ ID NO: 726755 - DNA, 25 bp, Artificial sequence
  Synthetic oligonucleotide
cgaaagggccgacgaggagcccaag

SEQ ID NO: 726756 - DNA, 25 bp, Artificial sequence
  Synthetic oligonucleotide
gaggccgaaagggccgacgaggagc

SEQ ID NO: 726757 - DNA, 25 bp, Artificial sequence
  Synthetic oligonucleotide
tcctcgaggccgaaagggccgacga

SEQ ID NO: 726758 - DNA, 25 bp, Artificial sequence
  Synthetic oligonucleotide
cgaagccttcctcgaggccgaaagg

SEQ ID NO: 726759 - DNA, 25 bp, Artificial sequence
  Synthetic oligonucleotide
agctgcgaagccttcctcgaggccg

SEQ ID NO: 726760 - DNA, 25 bp, Artificial sequence
  Synthetic oligonucleotide
ggtgttcacgaagatccacgtgcac

SEQ ID NO: 726761 - DNA, 25 bp, Artificial sequence
  Synthetic oligonucleotide
actgtccttgggccctgtgctaagc

SEQ ID NO: 726762 - DNA, 25 bp, Artificial sequence
  Synthetic oligonucleotide
gagtctgaacgatgaaagcgcgtat

SEQ ID NO: 726763 - DNA, 25 bp, Artificial sequence
  Synthetic oligonucleotide
cggcgggagtctgaacgatgaaagc

SEQ ID NO: 726764 - DNA, 25 bp, Artificial sequence
  Synthetic oligonucleotide
ctttgccggcgggagtctgaacgat

SEQ ID NO: 726765 - DNA, 25 bp, Artificial sequence
  Synthetic oligonucleotide
tggcgccctttgccggcgggagtct

SEQ ID NO: 726766 - DNA, 25 bp, Artificial sequence
  Synthetic oligonucleotide
ctaagctggcgccctttgccggcgg

SEQ ID NO: 726767 - DNA, 25 bp, Artificial sequence
  Synthetic oligonucleotide
acctcggggtgcgccctatggagat

SEQ ID NO: 726768 - DNA, 25 bp, Artificial sequence
  Synthetic oligonucleotide
cttgggccctgtgctaagctggcgc

SEQ ID NO: 726769 - DNA, 25 bp, Artificial sequence
  Synthetic oligonucleotide
gcgcgtatccagtgggcgggcgagg

SEQ ID NO: 726770 - DNA, 25 bp, Artificial sequence
  Synthetic oligonucleotide
tcccgtactgtccttgggccctgtg

SEQ ID NO: 726771 - DNA, 25 bp, Artificial sequence
  Synthetic oligonucleotide
tgtgatcccgtactgtccttgggcc

SEQ ID NO: 726772 - DNA, 25 bp, Artificial sequence
  Synthetic oligonucleotide
caggactgtgatcccgtactgtcct

SEQ ID NO: 726773 - DNA, 25 bp, Artificial sequence
  Synthetic oligonucleotide
gctatcaggactgtgatcccgtact

SEQ ID NO: 726774 - DNA, 25 bp, Artificial sequence
  Synthetic oligonucleotide
gacgcagctatcaggactgtgatcc

SEQ ID NO: 726775 - DNA, 25 bp, Artificial sequence
  Synthetic oligonucleotide
ttttgcgacgcagctatcaggactg

SEQ ID NO: 726776 - DNA, 25 bp, Artificial sequence
  Synthetic oligonucleotide
ccctgtgctaagctggcgccctttg

SEQ ID NO: 726777 - DNA, 25 bp, Artificial sequence
  Synthetic oligonucleotide
cggcgagtccggtagcggccacgtg

SEQ ID NO: 726778 - DNA, 25 bp, Artificial sequence
  Synthetic oligonucleotide
tcgccgaagaaatcaccgctgttga

SEQ ID NO: 726779 - DNA, 25 bp, Artificial sequence
  Synthetic oligonucleotide
cggaccatggcggacgcaacctcgg

SEQ ID NO: 726780 - DNA, 25 bp, Artificial sequence
  Synthetic oligonucleotide
gtccgccggaccatggcggacgcaa

SEQ ID NO: 726781 - DNA, 25 bp, Artificial sequence
  Synthetic oligonucleotide
tggacggtccgccggaccatggcgg

SEQ ID NO: 726782 - DNA, 25 bp, Artificial sequence
  Synthetic oligonucleotide
tggtcatggacggtccgccggacca

SEQ ID NO: 726783 - DNA, 25 bp, Artificial sequence
  Synthetic oligonucleotide
cacgtggtggtcatggacggtccgc

SEQ ID NO: 726784 - DNA, 25 bp, Artificial sequence
  Synthetic oligonucleotide
tgaacgatgaaagcgcgtatccagt

SEQ ID NO: 726785 - DNA, 25 bp, Artificial sequence
  Synthetic oligonucleotide
tccggtagcggccacgtggtggtca

SEQ ID NO: 726786 - DNA, 25 bp, Artificial sequence
  Synthetic oligonucleotide
atgaaagcgcgtatccagtgggcgg

SEQ ID NO: 726787 - DNA, 25 bp, Artificial sequence
  Synthetic oligonucleotide
gttcctcggcgagtccggtagcggc

SEQ ID NO: 726788 - DNA, 25 bp, Artificial sequence
  Synthetic oligonucleotide
ggcgatgttcctcggcgagtccggt

SEQ ID NO: 726789 - DNA, 25 bp, Artificial sequence
  Synthetic oligonucleotide
gggcgaggcgatgttcctcggcgag

SEQ ID NO: 726790 - DNA, 25 bp, Artificial sequence
  Synthetic oligonucleotide
gtgggcgggcgaggcgatgttcctc

SEQ ID NO: 726791 - DNA, 25 bp, Artificial sequence
  Synthetic oligonucleotide
atccagtgggcgggcgaggcgatgt

SEQ ID NO: 726792 - DNA, 25 bp, Artificial sequence
  Synthetic oligonucleotide
gacgcaacctcggggtgcgccctat

SEQ ID NO: 726793 - DNA, 25 bp, Artificial sequence
  Synthetic oligonucleotide
agcggccacgtggtggtcatggacg

SEQ ID NO: 726794 - DNA, 25 bp, Artificial sequence
  Synthetic oligonucleotide
ggccgacgatcctggcctcgagctg

SEQ ID NO: 726795 - DNA, 25 bp, Artificial sequence
  Synthetic oligonucleotide
atggtctttcctttcacatgcacca

SEQ ID NO: 726796 - DNA, 25 bp, Artificial sequence
  Synthetic oligonucleotide
ttccaggagcgtggtgctgtggtgc

SEQ ID NO: 726797 - DNA, 25 bp, Artificial sequence
  Synthetic oligonucleotide
tgttcttccaggagcgtggtgctgt

SEQ ID NO: 726798 - DNA, 25 bp, Artificial sequence
  Synthetic oligonucleotide
aagcgcctgttcttccaggagcgtg

SEQ ID NO: 726799 - DNA, 25 bp, Artificial sequence
  Synthetic oligonucleotide
gagctgaagcgcctgttcttccagg

SEQ ID NO: 726800 - DNA, 25 bp, Artificial sequence
  Synthetic oligonucleotide
ggtgctgtggtgctgggcgccgatc

SEQ ID NO: 726801 - DNA, 25 bp, Artificial sequence
  Synthetic oligonucleotide
cgatcctggcctcgagctgaagcgc

SEQ ID NO: 726802 - DNA, 25 bp, Artificial sequence
  Synthetic oligonucleotide
gtggtgctgggcgccgatcctgact

SEQ ID NO: 726803 - DNA, 25 bp, Artificial sequence
  Synthetic oligonucleotide
tcatgcgggccgacgatcctggcct

SEQ ID NO: 726804 - DNA, 25 bp, Artificial sequence
  Synthetic oligonucleotide
aggcgttcatgcgggccgacgatcc

SEQ ID NO: 726805 - DNA, 25 bp, Artificial sequence
  Synthetic oligonucleotide
ttggcgaggcgttcatgcgggccga

SEQ ID NO: 726806 - DNA, 25 bp, Artificial sequence
  Synthetic oligonucleotide
tcctggttggcgaggcgttcatgcg

SEQ ID NO: 726807 - DNA, 25 bp, Artificial sequence
  Synthetic oligonucleotide
acgccttcctggttggcgaggcgtt

SEQ ID NO: 726808 - DNA, 25 bp, Artificial sequence
  Synthetic oligonucleotide
aggtctacgccttcctggttggcga

SEQ ID NO: 726809 - DNA, 25 bp, Artificial sequence
  Synthetic oligonucleotide
tggcctcgagctgaagcgcctgttc

SEQ ID NO: 726810 - DNA, 25 bp, Artificial sequence
  Synthetic oligonucleotide
ccggttgcgaccggcctttttcatg

SEQ ID NO: 726811 - DNA, 25 bp, Artificial sequence
  Synthetic oligonucleotide
tcaccgctgttgaggtagccgatga

SEQ ID NO: 726812 - DNA, 25 bp, Artificial sequence
  Synthetic oligonucleotide
cgggtgccgaagaccaccatggtct

SEQ ID NO: 726813 - DNA, 25 bp, Artificial sequence
  Synthetic oligonucleotide
gttcagcgggtgccgaagaccacca

SEQ ID NO: 726814 - DNA, 25 bp, Artificial sequence
  Synthetic oligonucleotide
gggtgctgttcagcgggtgccgaag

SEQ ID NO: 726815 - DNA, 25 bp, Artificial sequence
  Synthetic oligonucleotide
tttcatgggtgctgttcagcgggtg

SEQ ID NO: 726816 - DNA, 25 bp, Artificial sequence
  Synthetic oligonucleotide
gagcgtggtgctgtggtgctgggcg

SEQ ID NO: 726817 - DNA, 25 bp, Artificial sequence
  Synthetic oligonucleotide
gcgaccggcctttttcatgggtgct

SEQ ID NO: 726818 - DNA, 25 bp, Artificial sequence
  Synthetic oligonucleotide
ctgatggaagtcagcgaggtctacg

SEQ ID NO: 726819 - DNA, 25 bp, Artificial sequence
  Synthetic oligonucleotide
ccatgaaaaaggccggttgcgaccg

SEQ ID NO: 726820 - DNA, 25 bp, Artificial sequence
  Synthetic oligonucleotide
cgcgctgtcgaaccccatgaaaaag

SEQ ID NO: 726821 - DNA, 25 bp, Artificial sequence
  Synthetic oligonucleotide
tgatccgcgctgtcgaaccccatga

SEQ ID NO: 726822 - DNA, 25 bp, Artificial sequence
  Synthetic oligonucleotide
tcctgactgatccgcgctgtcgaac

SEQ ID NO: 726823 - DNA, 25 bp, Artificial sequence
  Synthetic oligonucleotide
gccgatcctgactgatccgcgctgt

SEQ ID NO: 726824 - DNA, 25 bp, Artificial sequence
  Synthetic oligonucleotide
ctgggcgccgatcctgactgatccg

SEQ ID NO: 726825 - DNA, 25 bp, Artificial sequence
  Synthetic oligonucleotide
ggcctttttcatgggtgctgttcag

SEQ ID NO: 726826 - DNA, 25 bp, Artificial sequence
  Synthetic oligonucleotide
cactgaagaccctggacacgccgtt

SEQ ID NO: 726827 - DNA, 25 bp, Artificial sequence
  Synthetic oligonucleotide
aaccgcaacctgcacaccttcgagg

SEQ ID NO: 726828 - DNA, 25 bp, Artificial sequence
  Synthetic oligonucleotide
atcaacaaccgcaacctgcacacct

SEQ ID NO: 726829 - DNA, 25 bp, Artificial sequence
  Synthetic oligonucleotide
tgggcatcaacaaccgcaacctgca

SEQ ID NO: 726830 - DNA, 25 bp, Artificial sequence
  Synthetic oligonucleotide
gttggtgggcatcaacaaccgcaac

SEQ ID NO: 726831 - DNA, 25 bp, Artificial sequence
  Synthetic oligonucleotide
cacgccgttggtgggcatcaacaac

SEQ ID NO: 726832 - DNA, 25 bp, Artificial sequence
  Synthetic oligonucleotide
cagcgaggtctacgccttcctggtt

SEQ ID NO: 726833 - DNA, 25 bp, Artificial sequence
  Synthetic oligonucleotide
aagaccctggacacgccgttggtgg

SEQ ID NO: 726834 - DNA, 25 bp, Artificial sequence
  Synthetic oligonucleotide
ttcgaggtgagcctggaaaccaccc

SEQ ID NO: 726835 - DNA, 25 bp, Artificial sequence
  Synthetic oligonucleotide
aacgtgcactgaagaccctggacac

SEQ ID NO: 726836 - DNA, 25 bp, Artificial sequence
  Synthetic oligonucleotide
agctggaacgtgcactgaagaccct

SEQ ID NO: 726837 - DNA, 25 bp, Artificial sequence
  Synthetic oligonucleotide
gcaccgagctggaacgtgcactgaa

SEQ ID NO: 726838 - DNA, 25 bp, Artificial sequence
  Synthetic oligonucleotide
atgacggcaccgagctggaacgtgc

SEQ ID NO: 726839 - DNA, 25 bp, Artificial sequence
  Synthetic oligonucleotide
aggacaggccgtagaagatcggatt

SEQ ID NO: 726840 - DNA, 25 bp, Artificial sequence
  Synthetic oligonucleotide
gccgaggcgttgatccgcgcggcga

SEQ ID NO: 726841 - DNA, 25 bp, Artificial sequence
  Synthetic oligonucleotide
ctggacacgccgttggtgggcatca

SEQ ID NO: 726842 - DNA, 25 bp, Artificial sequence
  Synthetic oligonucleotide
cgcctggtggtcaccgagagcggta

SEQ ID NO: 726843 - DNA, 25 bp, Artificial sequence
  Synthetic oligonucleotide
ttcacatgcaccaggccctgctcct

SEQ ID NO: 726844 - DNA, 25 bp, Artificial sequence
  Synthetic oligonucleotide
gtggagctgatggaagtcagcgagg

SEQ ID NO: 726845 - DNA, 25 bp, Artificial sequence
  Synthetic oligonucleotide
gccgacgtggagctgatggaagtca

SEQ ID NO: 726846 - DNA, 25 bp, Artificial sequence
  Synthetic oligonucleotide
aaccgggccgacgtggagctgatgg

SEQ ID NO: 726847 - DNA, 25 bp, Artificial sequence
  Synthetic oligonucleotide
attctcaaccgggccgacgtggagc

SEQ ID NO: 726848 - DNA, 25 bp, Artificial sequence
  Synthetic oligonucleotide
agcggtattctcaaccgggccgacg

SEQ ID NO: 726849 - DNA, 25 bp, Artificial sequence
  Synthetic oligonucleotide
aacctgcacaccttcgaggtgagcc

SEQ ID NO: 726850 - DNA, 25 bp, Artificial sequence
  Synthetic oligonucleotide
gtggtcaccgagagcggtattctca

SEQ ID NO: 726851 - DNA, 25 bp, Artificial sequence
  Synthetic oligonucleotide
cacaccttcgaggtgagcctggaaa

SEQ ID NO: 726852 - DNA, 25 bp, Artificial sequence
  Synthetic oligonucleotide
cgcgaccgcctggtggtcaccgaga

SEQ ID NO: 726853 - DNA, 25 bp, Artificial sequence
  Synthetic oligonucleotide
attccccgcgaccgcctggtggtca

SEQ ID NO: 726854 - DNA, 25 bp, Artificial sequence
  Synthetic oligonucleotide
ccaccctcgacctgttgccggaaat

SEQ ID NO: 726855 - DNA, 25 bp, Artificial sequence
  Synthetic oligonucleotide
ctggaaaccaccctcgacctgttgc

SEQ ID NO: 726856 - DNA, 25 bp, Artificial sequence
  Synthetic oligonucleotide
ggtgagcctggaaaccaccctcgac

SEQ ID NO: 726857 - DNA, 25 bp, Artificial sequence
  Synthetic oligonucleotide
gaagtcagcgaggtctacgccttcc

SEQ ID NO: 726858 - DNA, 25 bp, Artificial sequence
  Synthetic oligonucleotide
accgagagcggtattctcaaccggg

SEQ ID NO: 726859 - DNA, 25 bp, Artificial sequence
  Synthetic oligonucleotide
tgccgagggtgtagaggatctccga

SEQ ID NO: 726860 - DNA, 25 bp, Artificial sequence
  Synthetic oligonucleotide
ccgaagaccaccatggtctttcctt

SEQ ID NO: 726861 - DNA, 25 bp, Artificial sequence
  Synthetic oligonucleotide
acagttcgcggaacttcgcatagct

SEQ ID NO: 726862 - DNA, 25 bp, Artificial sequence
  Synthetic oligonucleotide
gctgcgacagttcgcggaacttcgc

SEQ ID NO: 726863 - DNA, 25 bp, Artificial sequence
  Synthetic oligonucleotide
agtcctgctgcgacagttcgcggaa

SEQ ID NO: 726864 - DNA, 25 bp, Artificial sequence
  Synthetic oligonucleotide
tctccgagtcctgctgcgacagttc

SEQ ID NO: 726865 - DNA, 25 bp, Artificial sequence
  Synthetic oligonucleotide
acttcgcatagctgatctcggcgac

SEQ ID NO: 726866 - DNA, 25 bp, Artificial sequence
  Synthetic oligonucleotide
gggtgtagaggatctccgagtcctg

SEQ ID NO: 726867 - DNA, 25 bp, Artificial sequence
  Synthetic oligonucleotide
catagctgatctcggcgacttcgca

SEQ ID NO: 726868 - DNA, 25 bp, Artificial sequence
  Synthetic oligonucleotide
tctggctgccgagggtgtagaggat

SEQ ID NO: 726869 - DNA, 25 bp, Artificial sequence
  Synthetic oligonucleotide
cggccatctggctgccgagggtgta

SEQ ID NO: 726870 - DNA, 25 bp, Artificial sequence
  Synthetic oligonucleotide
ggcggtcggccatctggctgccgag

SEQ ID NO: 726871 - DNA, 25 bp, Artificial sequence
  Synthetic oligonucleotide
tgcgcaggcggtcggccatctggct

SEQ ID NO: 726872 - DNA, 25 bp, Artificial sequence
  Synthetic oligonucleotide
tggtcttgcgcaggcggtcggccat

SEQ ID NO: 726873 - DNA, 25 bp, Artificial sequence
  Synthetic oligonucleotide
tgcgggtggtcttgcgcaggcggtc

SEQ ID NO: 726874 - DNA, 25 bp, Artificial sequence
  Synthetic oligonucleotide
agaggatctccgagtcctgctgcga

SEQ ID NO: 726875 - DNA, 25 bp, Artificial sequence
  Synthetic oligonucleotide
caggcgctgcgttcctgttcgctgc

SEQ ID NO: 726876 - DNA, 25 bp, Artificial sequence
  Synthetic oligonucleotide
cccagctcgccgaagaaatcaccgc

SEQ ID NO: 726877 - DNA, 25 bp, Artificial sequence
  Synthetic oligonucleotide
aacaatcccagctcgccgaagaaat

SEQ ID NO: 726878 - DNA, 25 bp, Artificial sequence
  Synthetic oligonucleotide
ttttcgaacaatcccagctcgccga

SEQ ID NO: 726879 - DNA, 25 bp, Artificial sequence
  Synthetic oligonucleotide
ccttccttttcgaacaatcccagct

SEQ ID NO: 726880 - DNA, 25 bp, Artificial sequence
  Synthetic oligonucleotide
tcgctgccttccttttcgaacaatc

SEQ ID NO: 726881 - DNA, 25 bp, Artificial sequence
  Synthetic oligonucleotide
cgcggaacttcgcatagctgatctc

SEQ ID NO: 726882 - DNA, 25 bp, Artificial sequence
  Synthetic oligonucleotide
tgcgttcctgttcgctgccttcctt

SEQ ID NO: 726883 - DNA, 25 bp, Artificial sequence
  Synthetic oligonucleotide
aaggccaggtcgcccaccttgcggg

SEQ ID NO: 726884 - DNA, 25 bp, Artificial sequence
  Synthetic oligonucleotide
acgaacccaggcgctgcgttcctgt

SEQ ID NO: 726885 - DNA, 25 bp, Artificial sequence
  Synthetic oligonucleotide
ccttggcacgaacccaggcgctgcg

SEQ ID NO: 726886 - DNA, 25 bp, Artificial sequence
  Synthetic oligonucleotide
attccaccttggcacgaacccaggc

SEQ ID NO: 726887 - DNA, 25 bp, Artificial sequence
  Synthetic oligonucleotide
acttcgcattccaccttggcacgaa

SEQ ID NO: 726888 - DNA, 25 bp, Artificial sequence
  Synthetic oligonucleotide
tcggcgacttcgcattccaccttgg

SEQ ID NO: 726889 - DNA, 25 bp, Artificial sequence
  Synthetic oligonucleotide
tgatctcggcgacttcgcattccac

SEQ ID NO: 726890 - DNA, 25 bp, Artificial sequence
  Synthetic oligonucleotide
cctgttcgctgccttccttttcgaa

SEQ ID NO: 726891 - DNA, 25 bp, Artificial sequence
  Synthetic oligonucleotide
cgtccgaccatttcccgcgagcagc

SEQ ID NO: 726892 - DNA, 25 bp, Artificial sequence
  Synthetic oligonucleotide
tcctggcgggtgatcttgatctgca

SEQ ID NO: 726893 - DNA, 25 bp, Artificial sequence
  Synthetic oligonucleotide
ccgatctcctggcgggtgatcttga

SEQ ID NO: 726894 - DNA, 25 bp, Artificial sequence
  Synthetic oligonucleotide
atccggccgatctcctggcgggtga

SEQ ID NO: 726895 - DNA, 25 bp, Artificial sequence
  Synthetic oligonucleotide
ccgacgatccggccgatctcctggc

SEQ ID NO: 726896 - DNA, 25 bp, Artificial sequence
  Synthetic oligonucleotide
gagcagccgacgatccggccgatct

SEQ ID NO: 726897 - DNA, 25 bp, Artificial sequence
  Synthetic oligonucleotide
ccaccttgcgggtggtcttgcgcag

SEQ ID NO: 726898 - DNA, 25 bp, Artificial sequence
  Synthetic oligonucleotide
accatttcccgcgagcagccgacga

SEQ ID NO: 726899 - DNA, 25 bp, Artificial sequence
  Synthetic oligonucleotide
atctgcatgccgtccgggtgggtca

SEQ ID NO: 726900 - DNA, 25 bp, Artificial sequence
  Synthetic oligonucleotide
gcacgcgtccgaccatttcccgcga

SEQ ID NO: 726901 - DNA, 25 bp, Artificial sequence
  Synthetic oligonucleotide
tcttcagcacgcgtccgaccatttc

SEQ ID NO: 726902 - DNA, 25 bp, Artificial sequence
  Synthetic oligonucleotide
tccaggctcttcagcacgcgtccga

SEQ ID NO: 726903 - DNA, 25 bp, Artificial sequence
  Synthetic oligonucleotide
tgctcctccaggctcttcagcacgc

SEQ ID NO: 726904 - DNA, 25 bp, Artificial sequence
  Synthetic oligonucleotide
aggccctgctcctccaggctcttca

SEQ ID NO: 726905 - DNA, 25 bp, Artificial sequence
  Synthetic oligonucleotide
tgcaccaggccctgctcctccaggc

SEQ ID NO: 726906 - DNA, 25 bp, Artificial sequence
  Synthetic oligonucleotide
tcccgcgagcagccgacgatccggc

SEQ ID NO: 726907 - DNA, 25 bp, Artificial sequence
  Synthetic oligonucleotide
gctggcacaggtccagcaaggtgcg

SEQ ID NO: 726908 - DNA, 25 bp, Artificial sequence
  Synthetic oligonucleotide
tttcctttcacatgcaccaggccct

SEQ ID NO: 726909 - DNA, 25 bp, Artificial sequence
  Synthetic oligonucleotide
tcgaggaaggccaggtcgcccacct

SEQ ID NO: 726910 - DNA, 25 bp, Artificial sequence
  Synthetic oligonucleotide
ggtgacgtcgaggaaggccaggtcg

SEQ ID NO: 726911 - DNA, 25 bp, Artificial sequence
  Synthetic oligonucleotide
cgtccggtgacgtcgaggaaggcca

SEQ ID NO: 726912 - DNA, 25 bp, Artificial sequence
  Synthetic oligonucleotide
gcgacgcgtccggtgacgtcgagga

SEQ ID NO: 726913 - DNA, 25 bp, Artificial sequence
  Synthetic oligonucleotide
ggtgcgggcgacgcgtccggtgacg

SEQ ID NO: 726914 - DNA, 25 bp, Artificial sequence
  Synthetic oligonucleotide
cgggtgatcttgatctgcatgccgt

SEQ ID NO: 726915 - DNA, 25 bp, Artificial sequence
  Synthetic oligonucleotide
acaggtccagcaaggtgcgggcgac

SEQ ID NO: 726916 - DNA, 25 bp, Artificial sequence
  Synthetic oligonucleotide
atcttgatctgcatgccgtccgggt

SEQ ID NO: 726917 - DNA, 25 bp, Artificial sequence
  Synthetic oligonucleotide
ccggttgctggcacaggtccagcaa

SEQ ID NO: 726918 - DNA, 25 bp, Artificial sequence
  Synthetic oligonucleotide
tggcgtccggttgctggcacaggtc

SEQ ID NO: 726919 - DNA, 25 bp, Artificial sequence
  Synthetic oligonucleotide
gggtcatggcgtccggttgctggca

SEQ ID NO: 726920 - DNA, 25 bp, Artificial sequence
  Synthetic oligonucleotide
ccgggtgggtcatggcgtccggttg

SEQ ID NO: 726921 - DNA, 25 bp, Artificial sequence
  Synthetic oligonucleotide
atgccgtccgggtgggtcatggcgt

SEQ ID NO: 726922 - DNA, 25 bp, Artificial sequence
  Synthetic oligonucleotide
aggtcgcccaccttgcgggtggtct

SEQ ID NO: 726923 - DNA, 25 bp, Artificial sequence
  Synthetic oligonucleotide
cagcaaggtgcgggcgacgcgtccg

SEQ ID NO: 726924 - DNA, 25 bp, Artificial sequence
  Synthetic oligonucleotide
aggcctaccagatgaccgacgtgaa

SEQ ID NO: 726925 - DNA, 25 bp, Artificial sequence
  Synthetic oligonucleotide
cggctcaagcacgaaatgctggaga

SEQ ID NO: 726926 - DNA, 25 bp, Artificial sequence
  Synthetic oligonucleotide
agaacctgttccacaccaagatgct

SEQ ID NO: 726927 - DNA, 25 bp, Artificial sequence
  Synthetic oligonucleotide
accaggagaacctgttccacaccaa

SEQ ID NO: 726928 - DNA, 25 bp, Artificial sequence
  Synthetic oligonucleotide
acgtgtaccaggagaacctgttcca

SEQ ID NO: 726929 - DNA, 25 bp, Artificial sequence
  Synthetic oligonucleotide
acgtgaacgtgtaccaggagaacct

SEQ ID NO: 726930 - DNA, 25 bp, Artificial sequence
  Synthetic oligonucleotide
caccaagatgctgctcaaggacttc

SEQ ID NO: 726931 - DNA, 25 bp, Artificial sequence
  Synthetic oligonucleotide
accagatgaccgacgtgaacgtgta

SEQ ID NO: 726932 - DNA, 25 bp, Artificial sequence
  Synthetic oligonucleotide
gatgctgctcaaggacttcgaactg

SEQ ID NO: 726933 - DNA, 25 bp, Artificial sequence
  Synthetic oligonucleotide
cgcgcgaggcctaccagatgaccga

SEQ ID NO: 726934 - DNA, 25 bp, Artificial sequence
  Synthetic oligonucleotide
acgacacgcgcgaggcctaccagat

SEQ ID NO: 726935 - DNA, 25 bp, Artificial sequence
  Synthetic oligonucleotide
ctctccgacgacacgcgcgaggcct

SEQ ID NO: 726936 - DNA, 25 bp, Artificial sequence
  Synthetic oligonucleotide
aactatctctccgacgacacgcgcg

SEQ ID NO: 726937 - DNA, 25 bp, Artificial sequence
  Synthetic oligonucleotide
atccagaactatctctccgacgaca

SEQ ID NO: 726938 - DNA, 25 bp, Artificial sequence
  Synthetic oligonucleotide
aactcgatccagaactatctctccg

SEQ ID NO: 726939 - DNA, 25 bp, Artificial sequence
  Synthetic oligonucleotide
tgaccgacgtgaacgtgtaccagga

SEQ ID NO: 726940 - DNA, 25 bp, Artificial sequence
  Synthetic oligonucleotide
acgctacccggacgctctcggcgga

SEQ ID NO: 726941 - DNA, 25 bp, Artificial sequence
  Synthetic oligonucleotide
gtgcatacctacccggaaatccatc

SEQ ID NO: 726942 - DNA, 25 bp, Artificial sequence
  Synthetic oligonucleotide
caggtcacggaacggctcaagcacg

SEQ ID NO: 726943 - DNA, 25 bp, Artificial sequence
  Synthetic oligonucleotide
cgtgagcaggtcacggaacggctca

SEQ ID NO: 726944 - DNA, 25 bp, Artificial sequence
  Synthetic oligonucleotide
gaacagcgtgagcaggtcacggaac

SEQ ID NO: 726945 - DNA, 25 bp, Artificial sequence
  Synthetic oligonucleotide
tcggcggaacagcgtgagcaggtca

SEQ ID NO: 726946 - DNA, 25 bp, Artificial sequence
  Synthetic oligonucleotide
tgttccacaccaagatgctgctcaa

SEQ ID NO: 726947 - DNA, 25 bp, Artificial sequence
  Synthetic oligonucleotide
acccggacgctctcggcggaacagc

SEQ ID NO: 726948 - DNA, 25 bp, Artificial sequence
  Synthetic oligonucleotide
ttcatcgaccacgagatcaactcga

SEQ ID NO: 726949 - DNA, 25 bp, Artificial sequence
  Synthetic oligonucleotide
ttcggcgacgctacccggacgctct

SEQ ID NO: 726950 - DNA, 25 bp, Artificial sequence
  Synthetic oligonucleotide
tacctgttcggcgacgctacccgga

SEQ ID NO: 726951 - DNA, 25 bp, Artificial sequence
  Synthetic oligonucleotide
gagaactacctgttcggcgacgcta

SEQ ID NO: 726952 - DNA, 25 bp, Artificial sequence
  Synthetic oligonucleotide
gaactggagaactacctgttcggcg

SEQ ID NO: 726953 - DNA, 25 bp, Artificial sequence
  Synthetic oligonucleotide
ggacttcgaactggagaactacctg

SEQ ID NO: 726954 - DNA, 25 bp, Artificial sequence
  Synthetic oligonucleotide
gctcaaggacttcgaactggagaac

SEQ ID NO: 726955 - DNA, 25 bp, Artificial sequence
  Synthetic oligonucleotide
acgctctcggcggaacagcgtgagc

SEQ ID NO: 726956 - DNA, 25 bp, Artificial sequence
  Synthetic oligonucleotide
cgcgtggacatcgatgtgtccacct

SEQ ID NO: 726957 - DNA, 25 bp, Artificial sequence
  Synthetic oligonucleotide
gctgaaggccctgaactacctgatc

SEQ ID NO: 726958 - DNA, 25 bp, Artificial sequence
  Synthetic oligonucleotide
ctccccgctgaaggccctgaactac

SEQ ID NO: 726959 - DNA, 25 bp, Artificial sequence
  Synthetic oligonucleotide
gtgatctccccgctgaaggccctga

SEQ ID NO: 726960 - DNA, 25 bp, Artificial sequence
  Synthetic oligonucleotide
ctgcggagtgatctccccgctgaag

SEQ ID NO: 726961 - DNA, 25 bp, Artificial sequence
  Synthetic oligonucleotide
tccacctgcggagtgatctccccgc

SEQ ID NO: 726962 - DNA, 25 bp, Artificial sequence
  Synthetic oligonucleotide
gagatcaactcgatccagaactatc

SEQ ID NO: 726963 - DNA, 25 bp, Artificial sequence
  Synthetic oligonucleotide
gacatcgatgtgtccacctgcggag

SEQ ID NO: 726964 - DNA, 25 bp, Artificial sequence
  Synthetic oligonucleotide
acctgatccaccagttcgactcgga

SEQ ID NO: 726965 - DNA, 25 bp, Artificial sequence
  Synthetic oligonucleotide
accttccgcgtggacatcgatgtgt

SEQ ID NO: 726966 - DNA, 25 bp, Artificial sequence
  Synthetic oligonucleotide
atcgcgaccttccgcgtggacatcg

SEQ ID NO: 726967 - DNA, 25 bp, Artificial sequence
  Synthetic oligonucleotide
gacggcatcgcgaccttccgcgtgg

SEQ ID NO: 726968 - DNA, 25 bp, Artificial sequence
  Synthetic oligonucleotide
tccggtggacggcatcgcgaccttc

SEQ ID NO: 726969 - DNA, 25 bp, Artificial sequence
  Synthetic oligonucleotide
atccatccggtggacggcatcgcga

SEQ ID NO: 726970 - DNA, 25 bp, Artificial sequence
  Synthetic oligonucleotide
ccggaaatccatccggtggacggca

SEQ ID NO: 726971 - DNA, 25 bp, Artificial sequence
  Synthetic oligonucleotide
gatgtgtccacctgcggagtgatct

SEQ ID NO: 726972 - DNA, 25 bp, Artificial sequence
  Synthetic oligonucleotide
tcgactatcgggtccgcggcttcac

SEQ ID NO: 726973 - DNA, 25 bp, Artificial sequence
  Synthetic oligonucleotide
aagcacgaaatgctggagatcttct

SEQ ID NO: 726974 - DNA, 25 bp, Artificial sequence
  Synthetic oligonucleotide
aagcatttcatcgaccacgagatca

SEQ ID NO: 726975 - DNA, 25 bp, Artificial sequence
  Synthetic oligonucleotide
gggcgcaagcatttcatcgaccacg

SEQ ID NO: 726976 - DNA, 25 bp, Artificial sequence
  Synthetic oligonucleotide
catcgaggggcgcaagcatttcatc

SEQ ID NO: 726977 - DNA, 25 bp, Artificial sequence
  Synthetic oligonucleotide
cccgcgacatcgaggggcgcaagca

SEQ ID NO: 726978 - DNA, 25 bp, Artificial sequence
  Synthetic oligonucleotide
gcttcacccgcgacatcgaggggcg

SEQ ID NO: 726979 - DNA, 25 bp, Artificial sequence
  Synthetic oligonucleotide
ggccctgaactacctgatccaccag

SEQ ID NO: 726980 - DNA, 25 bp, Artificial sequence
  Synthetic oligonucleotide
atcgggtccgcggcttcacccgcga

SEQ ID NO: 726981 - DNA, 25 bp, Artificial sequence
  Synthetic oligonucleotide
gaactacctgatccaccagttcgac

SEQ ID NO: 726982 - DNA, 25 bp, Artificial sequence
  Synthetic oligonucleotide
tcacggtcgactatcgggtccgcgg

SEQ ID NO: 726983 - DNA, 25 bp, Artificial sequence
  Synthetic oligonucleotide
acatcgtcacggtcgactatcgggt

SEQ ID NO: 726984 - DNA, 25 bp, Artificial sequence
  Synthetic oligonucleotide
actcggacatcgtcacggtcgacta

SEQ ID NO: 726985 - DNA, 25 bp, Artificial sequence
  Synthetic oligonucleotide
agttcgactcggacatcgtcacggt

SEQ ID NO: 726986 - DNA, 25 bp, Artificial sequence
  Synthetic oligonucleotide
tccaccagttcgactcggacatcgt

SEQ ID NO: 726987 - DNA, 25 bp, Artificial sequence
  Synthetic oligonucleotide
gaccacgagatcaactcgatccaga

SEQ ID NO: 726988 - DNA, 25 bp, Artificial sequence
  Synthetic oligonucleotide
tccgcggcttcacccgcgacatcga

SEQ ID NO: 726989 - DNA, 25 bp, Artificial sequence
  Synthetic oligonucleotide
tttccgatcctcctggggaatctgc

SEQ ID NO: 726990 - DNA, 25 bp, Artificial sequence
  Synthetic oligonucleotide
acggaacggctcaagcacgaaatgc

SEQ ID NO: 726991 - DNA, 25 bp, Artificial sequence
  Synthetic oligonucleotide
cgtccagatgcttgcacacctggtc

SEQ ID NO: 726992 - DNA, 25 bp, Artificial sequence
  Synthetic oligonucleotide
ggtgttcgtccagatgcttgcacac

SEQ ID NO: 726993 - DNA, 25 bp, Artificial sequence
  Synthetic oligonucleotide
gcgccaggtgttcgtccagatgctt

SEQ ID NO: 726994 - DNA, 25 bp, Artificial sequence
  Synthetic oligonucleotide
gaatctgcgccaggtgttcgtccag

SEQ ID NO: 726995 - DNA, 25 bp, Artificial sequence
  Synthetic oligonucleotide
tgcacacctggtcttcggtggcggc

SEQ ID NO: 726996 - DNA, 25 bp, Artificial sequence
  Synthetic oligonucleotide
atcctcctggggaatctgcgccagg

SEQ ID NO: 726997 - DNA, 25 bp, Artificial sequence
  Synthetic oligonucleotide
cctggtcttcggtggcggcgacgaa

SEQ ID NO: 726998 - DNA, 25 bp, Artificial sequence
  Synthetic oligonucleotide
cacgggatttccgatcctcctgggg

SEQ ID NO: 726999 - DNA, 25 bp, Artificial sequence
  Synthetic oligonucleotide
gatggcacgggatttccgatcctcc

SEQ ID NO: 727000 - DNA, 25 bp, Artificial sequence
  Synthetic oligonucleotide
ctcgaggatggcacgggatttccga

SEQ ID NO: 727001 - DNA, 25 bp, Artificial sequence
  Synthetic oligonucleotide
atctgctcgaggatggcacgggatt

SEQ ID NO: 727002 - DNA, 25 bp, Artificial sequence
  Synthetic oligonucleotide
atacgcatctgctcgaggatggcac

SEQ ID NO: 727003 - DNA, 25 bp, Artificial sequence
  Synthetic oligonucleotide
tcgtcgatacgcatctgctcgagga

SEQ ID NO: 727004 - DNA, 25 bp, Artificial sequence
  Synthetic oligonucleotide
cctggggaatctgcgccaggtgttc

SEQ ID NO: 727005 - DNA, 25 bp, Artificial sequence
  Synthetic oligonucleotide
gtcgctgaccagcccggcggcggca

SEQ ID NO: 727006 - DNA, 25 bp, Artificial sequence
  Synthetic oligonucleotide
cgccgaaggacaggccgtagaagat

SEQ ID NO: 727007 - DNA, 25 bp, Artificial sequence
  Synthetic oligonucleotide
accgacgccgaaggacaggccgtag

SEQ ID NO: 727008 - DNA, 25 bp, Artificial sequence
  Synthetic oligonucleotide
accaccatggtctttcctttcacat

SEQ ID NO: 727009 - DNA, 25 bp, Artificial sequence
  Synthetic oligonucleotide
gcggtctcaaggaggcccaggtcaa

SEQ ID NO: 727010 - DNA, 25 bp, Artificial sequence
  Synthetic oligonucleotide
ggcggcaccgacgccgaaggacagg

SEQ ID NO: 727011 - DNA, 25 bp, Artificial sequence
  Synthetic oligonucleotide
gatgcttgcacacctggtcttcggt

SEQ ID NO: 727012 - DNA, 25 bp, Artificial sequence
  Synthetic oligonucleotide
gaccagcccggcggcggcaccgacg

SEQ ID NO: 727013 - DNA, 25 bp, Artificial sequence
  Synthetic oligonucleotide
ttgctcgaatgctgttcctcgtcga

SEQ ID NO: 727014 - DNA, 25 bp, Artificial sequence
  Synthetic oligonucleotide
gacccggtcgctgaccagcccggcg

SEQ ID NO: 727015 - DNA, 25 bp, Artificial sequence
  Synthetic oligonucleotide
aggctgacccggtcgctgaccagcc

SEQ ID NO: 727016 - DNA, 25 bp, Artificial sequence
  Synthetic oligonucleotide
aagcccaggctgacccggtcgctga

SEQ ID NO: 727017 - DNA, 25 bp, Artificial sequence
  Synthetic oligonucleotide
gcgacgaagcccaggctgacccggt

SEQ ID NO: 727018 - DNA, 25 bp, Artificial sequence
  Synthetic oligonucleotide
tggcggcgacgaagcccaggctgac

SEQ ID NO: 727019 - DNA, 25 bp, Artificial sequence
  Synthetic oligonucleotide
tcttcggtggcggcgacgaagccca

SEQ ID NO: 727020 - DNA, 25 bp, Artificial sequence
  Synthetic oligonucleotide
cccggcggcggcaccgacgccgaag

SEQ ID NO: 727021 - DNA, 25 bp, Artificial sequence
  Synthetic oligonucleotide
cgctgatcgcacacgaggaagaaaa

SEQ ID NO: 727022 - DNA, 25 bp, Artificial sequence
  Synthetic oligonucleotide
tttttcatgcgtgcgattcagatgc

SEQ ID NO: 727023 - DNA, 25 bp, Artificial sequence
  Synthetic oligonucleotide
gcgggctttttcatgcgtgcgattc

SEQ ID NO: 727024 - DNA, 25 bp, Artificial sequence
  Synthetic oligonucleotide
cttcgagcgggctttttcatgcgtg

SEQ ID NO: 727025 - DNA, 25 bp, Artificial sequence
  Synthetic oligonucleotide
agcccgcttcgagcgggctttttca

SEQ ID NO: 727026 - DNA, 25 bp, Artificial sequence
  Synthetic oligonucleotide
agaaaaagcccgcttcgagcgggct

SEQ ID NO: 727027 - DNA, 25 bp, Artificial sequence
  Synthetic oligonucleotide
tgttcctcgtcgatacgcatctgct

SEQ ID NO: 727028 - DNA, 25 bp, Artificial sequence
  Synthetic oligonucleotide
tcgcacacgaggaagaaaaagcccg

SEQ ID NO: 727029 - DNA, 25 bp, Artificial sequence
  Synthetic oligonucleotide
tcagatgcggtaggtgctcttggtc

SEQ ID NO: 727030 - DNA, 25 bp, Artificial sequence
  Synthetic oligonucleotide
atgccgcgctgatcgcacacgagga

SEQ ID NO: 727031 - DNA, 25 bp, Artificial sequence
  Synthetic oligonucleotide
cgcaacatgccgcgctgatcgcaca

SEQ ID NO: 727032 - DNA, 25 bp, Artificial sequence
  Synthetic oligonucleotide
tacgcgcgcaacatgccgcgctgat

SEQ ID NO: 727033 - DNA, 25 bp, Artificial sequence
  Synthetic oligonucleotide
atcttctacgcgcgcaacatgccgc

SEQ ID NO: 727034 - DNA, 25 bp, Artificial sequence
  Synthetic oligonucleotide
ctggagatcttctacgcgcgcaaca

SEQ ID NO: 727035 - DNA, 25 bp, Artificial sequence
  Synthetic oligonucleotide
gaaatgctggagatcttctacgcgc

SEQ ID NO: 727036 - DNA, 25 bp, Artificial sequence
  Synthetic oligonucleotide
cacgaggaagaaaaagcccgcttcg

SEQ ID NO: 727037 - DNA, 25 bp, Artificial sequence
  Synthetic oligonucleotide
gcaggctcatgcccagcttcaccgg

SEQ ID NO: 727038 - DNA, 25 bp, Artificial sequence
  Synthetic oligonucleotide
cgcaggccgccggcggccagggcgt

SEQ ID NO: 727039 - DNA, 25 bp, Artificial sequence
  Synthetic oligonucleotide
agggcgttgctcgaatgctgttcct

SEQ ID NO: 727040 - DNA, 25 bp, Artificial sequence
  Synthetic oligonucleotide
ccgccggcggccagggcgttgctcg

SEQ ID NO: 727041 - DNA, 25 bp, Artificial sequence
  Synthetic oligonucleotide
gggaagcgcaggccgccggcggcca

SEQ ID NO: 727042 - DNA, 25 bp, Artificial sequence
  Synthetic oligonucleotide
ggtgccgggaagcgcaggccgccgg

SEQ ID NO: 727043 - DNA, 25 bp, Artificial sequence
  Synthetic oligonucleotide
ttcaccggtgccgggaagcgcaggc

SEQ ID NO: 727044 - DNA, 25 bp, Artificial sequence
  Synthetic oligonucleotide
catgcgtgcgattcagatgcggtag

SEQ ID NO: 727045 - DNA, 25 bp, Artificial sequence
  Synthetic oligonucleotide
tcatgcccagcttcaccggtgccgg

SEQ ID NO: 727046 - DNA, 25 bp, Artificial sequence
  Synthetic oligonucleotide
tgcgattcagatgcggtaggtgctc

SEQ ID NO: 727047 - DNA, 25 bp, Artificial sequence
  Synthetic oligonucleotide
ttcgccagcaggctcatgcccagct

SEQ ID NO: 727048 - DNA, 25 bp, Artificial sequence
  Synthetic oligonucleotide
catcaccttcgccagcaggctcatg

SEQ ID NO: 727049 - DNA, 25 bp, Artificial sequence
  Synthetic oligonucleotide
cttggtcatcaccttcgccagcagg

SEQ ID NO: 727050 - DNA, 25 bp, Artificial sequence
  Synthetic oligonucleotide
ggtgctcttggtcatcaccttcgcc

SEQ ID NO: 727051 - DNA, 25 bp, Artificial sequence
  Synthetic oligonucleotide
gcggtaggtgctcttggtcatcacc

SEQ ID NO: 727052 - DNA, 25 bp, Artificial sequence
  Synthetic oligonucleotide
gaatgctgttcctcgtcgatacgca

SEQ ID NO: 727053 - DNA, 25 bp, Artificial sequence
  Synthetic oligonucleotide
ccagcttcaccggtgccgggaagcg

SEQ ID NO: 727054 - DNA, 25 bp, Artificial sequence
  Synthetic oligonucleotide
ggaagattcttccgctctgatagac

SEQ ID NO: 727055 - DNA, 25 bp, Artificial sequence
  Synthetic oligonucleotide
gtcgggtgaccaatggcgccagccg

SEQ ID NO: 727056 - DNA, 25 bp, Artificial sequence
  Synthetic oligonucleotide
atcccggtcgggtgaccaatggcgc

SEQ ID NO: 727057 - DNA, 25 bp, Artificial sequence
  Synthetic oligonucleotide
gagccatcccggtcgggtgaccaat

SEQ ID NO: 727058 - DNA, 25 bp, Artificial sequence
  Synthetic oligonucleotide
ttcccgagccatcccggtcgggtga

SEQ ID NO: 727059 - DNA, 25 bp, Artificial sequence
  Synthetic oligonucleotide
tgatagacgtttcccgagccatccc

SEQ ID NO: 727060 - DNA, 25 bp, Artificial sequence
  Synthetic oligonucleotide
gcgccccttttttcgtgccgcgcga

SEQ ID NO: 727061 - DNA, 25 bp, Artificial sequence
  Synthetic oligonucleotide
ttcttccgctctgatagacgtttcc

SEQ ID NO: 727062 - DNA, 25 bp, Artificial sequence
  Synthetic oligonucleotide
cagccggcgcccgtgcaactcaaca

SEQ ID NO: 727063 - DNA, 25 bp, Artificial sequence
  Synthetic oligonucleotide
tcagttcggaagattcttccgctct

SEQ ID NO: 727064 - DNA, 25 bp, Artificial sequence
  Synthetic oligonucleotide
ggccgttcagttcggaagattcttc

SEQ ID NO: 727065 - DNA, 25 bp, Artificial sequence
  Synthetic oligonucleotide
tcgggcggccgttcagttcggaaga

SEQ ID NO: 727066 - DNA, 25 bp, Artificial sequence
  Synthetic oligonucleotide
cgcgcgattccgtcgggcggccgtt

SEQ ID NO: 727067 - DNA, 25 bp, Artificial sequence
  Synthetic oligonucleotide
tcgtgccgcgcgattccgtcgggcg

SEQ ID NO: 727068 - DNA, 25 bp, Artificial sequence
  Synthetic oligonucleotide
ggcatgccccaaccctgcggcagag

SEQ ID NO: 727069 - DNA, 25 bp, Artificial sequence
  Synthetic oligonucleotide
cgctctgatagacgtttcccgagcc

SEQ ID NO: 727070 - DNA, 25 bp, Artificial sequence
  Synthetic oligonucleotide
catcgcgaagaggtgttaaccgtcc

SEQ ID NO: 727071 - DNA, 25 bp, Artificial sequence
  Synthetic oligonucleotide
ctgacgggcatgccccaaccctgcg

SEQ ID NO: 727072 - DNA, 25 bp, Artificial sequence
  Synthetic oligonucleotide
tcgcatctgacgggcatgccccaac

SEQ ID NO: 727073 - DNA, 25 bp, Artificial sequence
  Synthetic oligonucleotide
cgtcgttcgcatctgacgggcatgc

SEQ ID NO: 727074 - DNA, 25 bp, Artificial sequence
  Synthetic oligonucleotide
caggtgcgtcgttcgcatctgacgg

SEQ ID NO: 727075 - DNA, 25 bp, Artificial sequence
  Synthetic oligonucleotide
ctacgcaggtgcgtcgttcgcatct

SEQ ID NO: 727076 - DNA, 25 bp, Artificial sequence
  Synthetic oligonucleotide
accgtcctacgcaggtgcgtcgttc

SEQ ID NO: 727077 - DNA, 25 bp, Artificial sequence
  Synthetic oligonucleotide
tgaccaatggcgccagccggcgccc

SEQ ID NO: 727078 - DNA, 25 bp, Artificial sequence
  Synthetic oligonucleotide
gaagaggtgttaaccgtcctacgca

SEQ ID NO: 727079 - DNA, 25 bp, Artificial sequence
  Synthetic oligonucleotide
atggcgccagccggcgcccgtgcaa

SEQ ID NO: 727080 - DNA, 25 bp, Artificial sequence
  Synthetic oligonucleotide
aatcgccatcgcgaagaggtgttaa

SEQ ID NO: 727081 - DNA, 25 bp, Artificial sequence
  Synthetic oligonucleotide
aaccacaatcgccatcgcgaagagg

SEQ ID NO: 727082 - DNA, 25 bp, Artificial sequence
  Synthetic oligonucleotide
ctcaacaaaccacaatcgccatcgc

SEQ ID NO: 727083 - DNA, 25 bp, Artificial sequence
  Synthetic oligonucleotide
gtgcaactcaacaaaccacaatcgc

SEQ ID NO: 727084 - DNA, 25 bp, Artificial sequence
  Synthetic oligonucleotide
gcgcccgtgcaactcaacaaaccac

SEQ ID NO: 727085 - DNA, 25 bp, Artificial sequence
  Synthetic oligonucleotide
cataatgcgccccttttttcgtgcc

SEQ ID NO: 727086 - DNA, 25 bp, Artificial sequence
  Synthetic oligonucleotide
gtgttaaccgtcctacgcaggtgcg

SEQ ID NO: 727087 - DNA, 25 bp, Artificial sequence
  Synthetic oligonucleotide
cggtggagctgtcggcggagaaata

SEQ ID NO: 727088 - DNA, 25 bp, Artificial sequence
  Synthetic oligonucleotide
catgctcggtcgcggcggggtggag

SEQ ID NO: 727089 - DNA, 25 bp, Artificial sequence
  Synthetic oligonucleotide
gtcgatcatgctcggtcgcggcggg

SEQ ID NO: 727090 - DNA, 25 bp, Artificial sequence
  Synthetic oligonucleotide
tcggcgtcgatcatgctcggtcgcg

SEQ ID NO: 727091 - DNA, 25 bp, Artificial sequence
  Synthetic oligonucleotide
tactgctcggcgtcgatcatgctcg

SEQ ID NO: 727092 - DNA, 25 bp, Artificial sequence
  Synthetic oligonucleotide
gagaaatactgctcggcgtcgatca

SEQ ID NO: 727093 - DNA, 25 bp, Artificial sequence
  Synthetic oligonucleotide
cttttttcgtgccgcgcgattccgt

SEQ ID NO: 727094 - DNA, 25 bp, Artificial sequence
  Synthetic oligonucleotide
agctgtcggcggagaaatactgctc

SEQ ID NO: 727095 - DNA, 25 bp, Artificial sequence
  Synthetic oligonucleotide
ggtggagatcacccacgactacgag

SEQ ID NO: 727096 - DNA, 25 bp, Artificial sequence
  Synthetic oligonucleotide
tcaccgtgcatacctacccggaaat

SEQ ID NO: 727097 - DNA, 25 bp, Artificial sequence
  Synthetic oligonucleotide
gcggccagggcgttgctcgaatgct

SEQ ID NO: 727098 - DNA, 25 bp, Artificial sequence
  Synthetic oligonucleotide
tcaaggaggcccaggtcaagcgcgc

SEQ ID NO: 727099 - DNA, 25 bp, Artificial sequence
  Synthetic oligonucleotide
aggcccaggtcaagcgcgcggtgga

SEQ ID NO: 727100 - DNA, 25 bp, Artificial sequence
  Synthetic oligonucleotide
agcgcgcggtggagctgtcggcgga

SEQ ID NO: 727101 - DNA, 25 bp, Artificial sequence
  Synthetic oligonucleotide
aggtcaagcgcgcggtggagctgtc

SEQ ID NO: 727102 - DNA, 25 bp, Artificial sequence
  Synthetic oligonucleotide
tcggcggagaaatactgctcggcgt

SEQ ID NO: 727103 - DNA, 25 bp, Artificial sequence
  Synthetic oligonucleotide
catccggtcatcataaaaggggcgc

SEQ ID NO: 727104 - DNA, 25 bp, Artificial sequence
  Synthetic oligonucleotide
gctctgcataatgcgcccctttttt

SEQ ID NO: 727105 - DNA, 25 bp, Artificial sequence
  Synthetic oligonucleotide
gattggctctgcataatgcgcccct

SEQ ID NO: 727106 - DNA, 25 bp, Artificial sequence
  Synthetic oligonucleotide
aggcttgattggctctgcataatgc

SEQ ID NO: 727107 - DNA, 25 bp, Artificial sequence
  Synthetic oligonucleotide
tggcggaggcttgattggctctgca

SEQ ID NO: 727108 - DNA, 25 bp, Artificial sequence
  Synthetic oligonucleotide
aaactctggcggaggcttgattggc

SEQ ID NO: 727109 - DNA, 25 bp, Artificial sequence
  Synthetic oligonucleotide
gggcgcaaactctggcggaggcttg

SEQ ID NO: 727110 - DNA, 25 bp, Artificial sequence
  Synthetic oligonucleotide
cggtcgcggcggggtggagatcacc

SEQ ID NO: 727111 - DNA, 25 bp, Artificial sequence
  Synthetic oligonucleotide
gtcatcataaaaggggcgcaaactc

SEQ ID NO: 727112 - DNA, 25 bp, Artificial sequence
  Synthetic oligonucleotide
cggcggggtggagatcacccacgac

SEQ ID NO: 727113 - DNA, 25 bp, Artificial sequence
  Synthetic oligonucleotide
cggctgagacgacatccggtcatca

SEQ ID NO: 727114 - DNA, 25 bp, Artificial sequence
  Synthetic oligonucleotide
gatcgtcgaactcggctgagacgac

SEQ ID NO: 727115 - DNA, 25 bp, Artificial sequence
  Synthetic oligonucleotide
tacgagatcgtcgaactcggctgag

SEQ ID NO: 727116 - DNA, 25 bp, Artificial sequence
  Synthetic oligonucleotide
cacgactacgagatcgtcgaactcg

SEQ ID NO: 727117 - DNA, 25 bp, Artificial sequence
  Synthetic oligonucleotide
gatcacccacgactacgagatcgtc

SEQ ID NO: 727118 - DNA, 25 bp, Artificial sequence
  Synthetic oligonucleotide
agacgacatccggtcatcataaaag

SEQ ID NO: 727119 - DNA, 25 bp, Artificial sequence
  Synthetic oligonucleotide
taaaaggggcgcaaactctggcgga

SEQ ID NO: 727120 - DNA, 25 bp, Artificial sequence
  Synthetic oligonucleotide
gcgccaatatcctgaacatcgcgcg

SEQ ID NO: 727121 - DNA, 25 bp, Artificial sequence
  Synthetic oligonucleotide
agcgtctgacgcagattcttaccga

SEQ ID NO: 727122 - DNA, 25 bp, Artificial sequence
  Synthetic oligonucleotide
agggcgccagcgtgaccatcctgat

SEQ ID NO: 727123 - DNA, 25 bp, Artificial sequence
  Synthetic oligonucleotide
acccccagggcgccagcgtgaccat

SEQ ID NO: 727124 - DNA, 25 bp, Artificial sequence
  Synthetic oligonucleotide
actacgacccccagggcgccagcgt

SEQ ID NO: 727125 - DNA, 25 bp, Artificial sequence
  Synthetic oligonucleotide
gtcaggactacgacccccagggcgc

SEQ ID NO: 727126 - DNA, 25 bp, Artificial sequence
  Synthetic oligonucleotide
tcgcgcgtcaggactacgaccccca

SEQ ID NO: 727127 - DNA, 25 bp, Artificial sequence
  Synthetic oligonucleotide
gaccatcctgatctccgagcagccg

SEQ ID NO: 727128 - DNA, 25 bp, Artificial sequence
  Synthetic oligonucleotide
atatcctgaacatcgcgcgtcagga

SEQ ID NO: 727129 - DNA, 25 bp, Artificial sequence
  Synthetic oligonucleotide
cctgatctccgagcagccggtcact

SEQ ID NO: 727130 - DNA, 25 bp, Artificial sequence
  Synthetic oligonucleotide
tcatcggcgccaatatcctgaacat

SEQ ID NO: 727131 - DNA, 25 bp, Artificial sequence
  Synthetic oligonucleotide
tcgacatcatcggcgccaatatcct

SEQ ID NO: 727132 - DNA, 25 bp, Artificial sequence
  Synthetic oligonucleotide
atgttgtcgacatcatcggcgccaa

SEQ ID NO: 727133 - DNA, 25 bp, Artificial sequence
  Synthetic oligonucleotide
ttaccgatgttgtcgacatcatcgg

SEQ ID NO: 727134 - DNA, 25 bp, Artificial sequence
  Synthetic oligonucleotide
agattcttaccgatgttgtcgacat

SEQ ID NO: 727135 - DNA, 25 bp, Artificial sequence
  Synthetic oligonucleotide
tgacgcagattcttaccgatgttgt

SEQ ID NO: 727136 - DNA, 25 bp, Artificial sequence
  Synthetic oligonucleotide
tgaacatcgcgcgtcaggactacga

SEQ ID NO: 727137 - DNA, 25 bp, Artificial sequence
  Synthetic oligonucleotide
cgctgccggacaccatcctggcgca

SEQ ID NO: 727138 - DNA, 25 bp, Artificial sequence
  Synthetic oligonucleotide
tggcgcacctggacaagagccacat

SEQ ID NO: 727139 - DNA, 25 bp, Artificial sequence
  Synthetic oligonucleotide
acctggacaagagccacatcaccgt

SEQ ID NO: 727140 - DNA, 25 bp, Artificial sequence
  Synthetic oligonucleotide
ccatcctggcgcacctggacaagag

SEQ ID NO: 727141 - DNA, 25 bp, Artificial sequence
  Synthetic oligonucleotide
acaagagccacatcaccgtgcatac

SEQ ID NO: 727142 - DNA, 25 bp, Artificial sequence
  Synthetic oligonucleotide
gccacatcaccgtgcatacctaccc

SEQ ID NO: 727143 - DNA, 25 bp, Artificial sequence
  Synthetic oligonucleotide
cgaactcggctgagacgacatccgg

SEQ ID NO: 727144 - DNA, 25 bp, Artificial sequence
  Synthetic oligonucleotide
cagcgtgaccatcctgatctccgag

SEQ ID NO: 727145 - DNA, 25 bp, Artificial sequence
  Synthetic oligonucleotide
cggacaccatcctggcgcacctgga

SEQ ID NO: 727146 - DNA, 25 bp, Artificial sequence
  Synthetic oligonucleotide
tccgagcagccggtcactccgaccg

SEQ ID NO: 727147 - DNA, 25 bp, Artificial sequence
  Synthetic oligonucleotide
ccgggcccgctgccggacaccatcc

SEQ ID NO: 727148 - DNA, 25 bp, Artificial sequence
  Synthetic oligonucleotide
gagtccccgggcccgctgccggaca

SEQ ID NO: 727149 - DNA, 25 bp, Artificial sequence
  Synthetic oligonucleotide
agatcgaagagtccccgggcccgct

SEQ ID NO: 727150 - DNA, 25 bp, Artificial sequence
  Synthetic oligonucleotide
gacagccagatcgaagagtccccgg

SEQ ID NO: 727151 - DNA, 25 bp, Artificial sequence
  Synthetic oligonucleotide
ccgaccgacagccagatcgaagagt

SEQ ID NO: 727152 - DNA, 25 bp, Artificial sequence
  Synthetic oligonucleotide
cagccggtcactccgaccgacagcc

SEQ ID NO: 727153 - DNA, 25 bp, Artificial sequence
  Synthetic oligonucleotide
ccccaaccctgcggcagagccgcaa

SEQ ID NO: 727154 - DNA, 25 bp, Artificial sequence
  Synthetic oligonucleotide
ttccccacggtgaaaagcaaactca

SEQ ID NO: 727155 - DNA, 25 bp, Artificial sequence
  Synthetic oligonucleotide
agcttcaacatctacgacatctgct

SEQ ID NO: 727156 - DNA, 25 bp, Artificial sequence
  Synthetic oligonucleotide
accttgagcttcaacatctacgaca

SEQ ID NO: 727157 - DNA, 25 bp, Artificial sequence
  Synthetic oligonucleotide
acgaagaccttgagcttcaacatct

SEQ ID NO: 727158 - DNA, 25 bp, Artificial sequence
  Synthetic oligonucleotide
aacctgacgaagaccttgagcttca

SEQ ID NO: 727159 - DNA, 25 bp, Artificial sequence
  Synthetic oligonucleotide
ttcaacaacctgacgaagaccttga

SEQ ID NO: 727160 - DNA, 25 bp, Artificial sequence
  Synthetic oligonucleotide
aagctccacgggttcaacaacctga

SEQ ID NO: 727161 - DNA, 25 bp, Artificial sequence
  Synthetic oligonucleotide
aacatctacgacatctgctacgccg

SEQ ID NO: 727162 - DNA, 25 bp, Artificial sequence
  Synthetic oligonucleotide
acggtgaaaagcaaactcaagctcc

SEQ ID NO: 727163 - DNA, 25 bp, Artificial sequence
  Synthetic oligonucleotide
cacgggttcaacaacctgacgaaga

SEQ ID NO: 727164 - DNA, 25 bp, Artificial sequence
  Synthetic oligonucleotide
ccctgcggcagagccgcaagcaacc

SEQ ID NO: 727165 - DNA, 25 bp, Artificial sequence
  Synthetic oligonucleotide
gtcactccgaccgacagccagatcg

SEQ ID NO: 727166 - DNA, 25 bp, Artificial sequence
  Synthetic oligonucleotide
cgagagagttccccacggtgaaaag

SEQ ID NO: 727167 - DNA, 25 bp, Artificial sequence
  Synthetic oligonucleotide
ggcagagccgcaagcaaccgagaga

SEQ ID NO: 727168 - DNA, 25 bp, Artificial sequence
  Synthetic oligonucleotide
aagcaaccgagagagttccccacgg

SEQ ID NO: 727169 - DNA, 25 bp, Artificial sequence
  Synthetic oligonucleotide
agccgcaagcaaccgagagagttcc

SEQ ID NO: 727170 - DNA, 25 bp, Artificial sequence
  Synthetic oligonucleotide
aaaagcaaactcaagctccacgggt

SEQ ID NO: 727171 - DNA, 25 bp, Artificial sequence
  Synthetic oligonucleotide
cgaagagtatgacgcggagcgtctg

SEQ ID NO: 727172 - DNA, 25 bp, Artificial sequence
  Synthetic oligonucleotide
cagtacatcgacgaagagtatgacg

SEQ ID NO: 727173 - DNA, 25 bp, Artificial sequence
  Synthetic oligonucleotide
aaactcaagctccacgggttcaaca

SEQ ID NO: 727174 - DNA, 25 bp, Artificial sequence
  Synthetic oligonucleotide
tacgacatctgctacgccgagacgc

SEQ ID NO: 727175 - DNA, 25 bp, Artificial sequence
  Synthetic oligonucleotide
tacgtgcagtacatcgacgaagagt

SEQ ID NO: 727176 - DNA, 25 bp, Artificial sequence
  Synthetic oligonucleotide
atcgacgaagagtatgacgcggagc

SEQ ID NO: 727177 - DNA, 25 bp, Artificial sequence
  Synthetic oligonucleotide
gacctccaggcctacgtgcagtaca

SEQ ID NO: 727178 - DNA, 25 bp, Artificial sequence
  Synthetic oligonucleotide
cccgaagacctccaggcctacgtgc

SEQ ID NO: 727179 - DNA, 25 bp, Artificial sequence
  Synthetic oligonucleotide
agtatgacgcggagcgtctgacgca

SEQ ID NO: 727180 - DNA, 25 bp, Artificial sequence
  Synthetic oligonucleotide
gagacgcccgaagacctccaggcct

SEQ ID NO: 727181 - DNA, 25 bp, Artificial sequence
  Synthetic oligonucleotide
tacgccgagacgcccgaagacctcc

SEQ ID NO: 727182 - DNA, 25 bp, Artificial sequence
  Synthetic oligonucleotide
acgcggagcgtctgacgcagattct

SEQ ID NO: 727183 - DNA, 25 bp, Artificial sequence
  Synthetic oligonucleotide
atctgctacgccgagacgcccgaag

SEQ ID NO: 727184 - DNA, 25 bp, Artificial sequence
  Synthetic oligonucleotide
caggcctacgtgcagtacatcgacg

SEQ ID NO: 727185 - DNA, 25 bp, Artificial sequence
  Synthetic oligonucleotide
tgcgaccgcggcgaccgctacctgt

SEQ ID NO: 727186 - DNA, 25 bp, Artificial sequence
  Synthetic oligonucleotide
tgagcatgtccatggccagaaataa

SEQ ID NO: 727187 - DNA, 25 bp, Artificial sequence
  Synthetic oligonucleotide
ctgcgcctgtcccgcgaactggaga

SEQ ID NO: 727188 - DNA, 25 bp, Artificial sequence
  Synthetic oligonucleotide
ctgtcccgcgaactggagaatgccg

SEQ ID NO: 727189 - DNA, 25 bp, Artificial sequence
  Synthetic oligonucleotide
ccgcgaactggagaatgccgtgctg

SEQ ID NO: 727190 - DNA, 25 bp, Artificial sequence
  Synthetic oligonucleotide
actggagaatgccgtgctggtggcg

SEQ ID NO: 727191 - DNA, 25 bp, Artificial sequence
  Synthetic oligonucleotide
gaatgccgtgctggtggcgatcatc

SEQ ID NO: 727192 - DNA, 25 bp, Artificial sequence
  Synthetic oligonucleotide
gcgatgctgcgcctgtcccgcgaac

SEQ ID NO: 727193 - DNA, 25 bp, Artificial sequence
  Synthetic oligonucleotide
cgtgctggtggcgatcatctgcgac

SEQ ID NO: 727194 - DNA, 25 bp, Artificial sequence
  Synthetic oligonucleotide
cgacgctggccgcaggaatacctgc

SEQ ID NO: 727195 - DNA, 25 bp, Artificial sequence
  Synthetic oligonucleotide
ggtggcgatcatctgcgaccgcggc

SEQ ID NO: 727196 - DNA, 25 bp, Artificial sequence
  Synthetic oligonucleotide
ggaatccgacgctggccgcaggaat

SEQ ID NO: 727197 - DNA, 25 bp, Artificial sequence
  Synthetic oligonucleotide
cgcggcgaccgctacctgtcttccg

SEQ ID NO: 727198 - DNA, 25 bp, Artificial sequence
  Synthetic oligonucleotide
gaccgctacctgtcttccggcgtct

SEQ ID NO: 727199 - DNA, 25 bp, Artificial sequence
  Synthetic oligonucleotide
tacctgtcttccggcgtctatgacc

SEQ ID NO: 727200 - DNA, 25 bp, Artificial sequence
  Synthetic oligonucleotide
gtggcggcgatgctgcgcctgtccc

SEQ ID NO: 727201 - DNA, 25 bp, Artificial sequence
  Synthetic oligonucleotide
ggacgaagccgaggacatcatgcgc

SEQ ID NO: 727202 - DNA, 25 bp, Artificial sequence
  Synthetic oligonucleotide
tcttccggcgtctatgacccgcgct

SEQ ID NO: 727203 - DNA, 25 bp, Artificial sequence
  Synthetic oligonucleotide
ggcgtctatgacccgcgctgagcat

SEQ ID NO: 727204 - DNA, 25 bp, Artificial sequence
  Synthetic oligonucleotide
ccgcgctgagcatgtccatggccag

SEQ ID NO: 727205 - DNA, 25 bp, Artificial sequence
  Synthetic oligonucleotide
tatgacccgcgctgagcatgtccat

SEQ ID NO: 727206 - DNA, 25 bp, Artificial sequence
  Synthetic oligonucleotide
gatcatctgcgaccgcggcgaccgc

SEQ ID NO: 727207 - DNA, 25 bp, Artificial sequence
  Synthetic oligonucleotide
caggaatacctgccgaagatctatg

SEQ ID NO: 727208 - DNA, 25 bp, Artificial sequence
  Synthetic oligonucleotide
tggccgcaggaatacctgccgaaga

SEQ ID NO: 727209 - DNA, 25 bp, Artificial sequence
  Synthetic oligonucleotide
tacctgccgaagatctatgacgcca

SEQ ID NO: 727210 - DNA, 25 bp, Artificial sequence
  Synthetic oligonucleotide
ccgaagatctatgacgccagtcgcg

SEQ ID NO: 727211 - DNA, 25 bp, Artificial sequence
  Synthetic oligonucleotide
aacttgaggcccgggtgctgggcgc

SEQ ID NO: 727212 - DNA, 25 bp, Artificial sequence
  Synthetic oligonucleotide
tgtccatggccagaaataagggcgg

SEQ ID NO: 727213 - DNA, 25 bp, Artificial sequence
  Synthetic oligonucleotide
atctatgacgccagtcgcgtcgacc

SEQ ID NO: 727214 - DNA, 25 bp, Artificial sequence
  Synthetic oligonucleotide
acgccagtcgcgtcgaccgggtcgt

SEQ ID NO: 727215 - DNA, 25 bp, Artificial sequence
  Synthetic oligonucleotide
gtcgcgtcgaccgggtcgtcgacat

SEQ ID NO: 727216 - DNA, 25 bp, Artificial sequence
  Synthetic oligonucleotide
cgaccgggtcgtcgacatgcaccag

SEQ ID NO: 727217 - DNA, 25 bp, Artificial sequence
  Synthetic oligonucleotide
ggtcgtcgacatgcaccaggacgaa

SEQ ID NO: 727218 - DNA, 25 bp, Artificial sequence
  Synthetic oligonucleotide
aggacatcatgcgccggctggcccg

SEQ ID NO: 727219 - DNA, 25 bp, Artificial sequence
  Synthetic oligonucleotide
gcaccaggacgaagccgaggacatc

SEQ ID NO: 727220 - DNA, 25 bp, Artificial sequence
  Synthetic oligonucleotide
ggggcggtggcggcgatgctgcgcc

SEQ ID NO: 727221 - DNA, 25 bp, Artificial sequence
  Synthetic oligonucleotide
aagccgaggacatcatgcgccggct

SEQ ID NO: 727222 - DNA, 25 bp, Artificial sequence
  Synthetic oligonucleotide
tcatgcgccggctggcccgcgagga

SEQ ID NO: 727223 - DNA, 25 bp, Artificial sequence
  Synthetic oligonucleotide
gccggctggcccgcgaggaaggcat

SEQ ID NO: 727224 - DNA, 25 bp, Artificial sequence
  Synthetic oligonucleotide
tggcccgcgaggaaggcatcttctg

SEQ ID NO: 727225 - DNA, 25 bp, Artificial sequence
  Synthetic oligonucleotide
cgcgaggaaggcatcttctgcggcg

SEQ ID NO: 727226 - DNA, 25 bp, Artificial sequence
  Synthetic oligonucleotide
gaaggcatcttctgcggcgtgtcct

SEQ ID NO: 727227 - DNA, 25 bp, Artificial sequence
  Synthetic oligonucleotide
atcttctgcggcgtgtcctccggtg

SEQ ID NO: 727228 - DNA, 25 bp, Artificial sequence
  Synthetic oligonucleotide
tgcggcgtgtcctccggtggggcgg

SEQ ID NO: 727229 - DNA, 25 bp, Artificial sequence
  Synthetic oligonucleotide
cgtgtcctccggtggggcggtggcg

SEQ ID NO: 727230 - DNA, 25 bp, Artificial sequence
  Synthetic oligonucleotide
tccggtggggcggtggcggcgatgc

SEQ ID NO: 727231 - DNA, 25 bp, Artificial sequence
  Synthetic oligonucleotide
cgacatgcaccaggacgaagccgag

SEQ ID NO: 727232 - DNA, 25 bp, Artificial sequence
  Synthetic oligonucleotide
gcagtagcgacctgcgtcgccgcga

SEQ ID NO: 727233 - DNA, 25 bp, Artificial sequence
  Synthetic oligonucleotide
gagggctgcctggcgaggaacttga

SEQ ID NO: 727234 - DNA, 25 bp, Artificial sequence
  Synthetic oligonucleotide
ggcgaggaacttgaggcccgggtgc

SEQ ID NO: 727235 - DNA, 25 bp, Artificial sequence
  Synthetic oligonucleotide
aggcccgggtgctgggcgcacgaag

SEQ ID NO: 727236 - DNA, 25 bp, Artificial sequence
  Synthetic oligonucleotide
gggtgctgggcgcacgaagcaaggt

SEQ ID NO: 727237 - DNA, 25 bp, Artificial sequence
  Synthetic oligonucleotide
tgggcgcacgaagcaaggtggtcga

SEQ ID NO: 727238 - DNA, 25 bp, Artificial sequence
  Synthetic oligonucleotide
cacgaagcaaggtggtcgacgcgcg

SEQ ID NO: 727239 - DNA, 25 bp, Artificial sequence
  Synthetic oligonucleotide
gcaaggtggtcgacgcgcgcagcga

SEQ ID NO: 727240 - DNA, 25 bp, Artificial sequence
  Synthetic oligonucleotide
ggtcgacgcgcgcagcgagcgcctg

SEQ ID NO: 727241 - DNA, 25 bp, Artificial sequence
  Synthetic oligonucleotide
acgcgcgcagcgagcgcctgttcag

SEQ ID NO: 727242 - DNA, 25 bp, Artificial sequence
  Synthetic oligonucleotide
gcagcgagcgcctgttcagcagtag

SEQ ID NO: 727243 - DNA, 25 bp, Artificial sequence
  Synthetic oligonucleotide
ctgcctggcgaggaacttgaggccc

SEQ ID NO: 727244 - DNA, 25 bp, Artificial sequence
  Synthetic oligonucleotide
tgttcagcagtagcgacctgcgtcg

SEQ ID NO: 727245 - DNA, 25 bp, Artificial sequence
  Synthetic oligonucleotide
tgacctggttcgtcagcggagggct

SEQ ID NO: 727246 - DNA, 25 bp, Artificial sequence
  Synthetic oligonucleotide
agcgacctgcgtcgccgcgagccct

SEQ ID NO: 727247 - DNA, 25 bp, Artificial sequence
  Synthetic oligonucleotide
ctgcgtcgccgcgagccctgcactg

SEQ ID NO: 727248 - DNA, 25 bp, Artificial sequence
  Synthetic oligonucleotide
cgccgcgagccctgcactgtagcgg

SEQ ID NO: 727249 - DNA, 25 bp, Artificial sequence
  Synthetic oligonucleotide
gagccctgcactgtagcgggtcgct

SEQ ID NO: 727250 - DNA, 25 bp, Artificial sequence
  Synthetic oligonucleotide
atcccgggaatccgacgctggccgc

SEQ ID NO: 727251 - DNA, 25 bp, Artificial sequence
  Synthetic oligonucleotide
ggccatggcggcggcgatcaagggt

SEQ ID NO: 727252 - DNA, 25 bp, Artificial sequence
  Synthetic oligonucleotide
tgcactgtagcgggtcgctgcggcg

SEQ ID NO: 727253 - DNA, 25 bp, Artificial sequence
  Synthetic oligonucleotide
gtagcgggtcgctgcggcggctgca

SEQ ID NO: 727254 - DNA, 25 bp, Artificial sequence
  Synthetic oligonucleotide
gtcgctgcggcggctgcaccctgca

SEQ ID NO: 727255 - DNA, 25 bp, Artificial sequence
  Synthetic oligonucleotide
gcggcggctgcaccctgcagcacct

SEQ ID NO: 727256 - DNA, 25 bp, Artificial sequence
  Synthetic oligonucleotide
agcgcctgttcagcagtagcgacct

SEQ ID NO: 727257 - DNA, 25 bp, Artificial sequence
  Synthetic oligonucleotide
agaagcagcgcctgaccatcgagcg

SEQ ID NO: 727258 - DNA, 25 bp, Artificial sequence
  Synthetic oligonucleotide
gaaataagggcgggctgcgcttcca

SEQ ID NO: 727259 - DNA, 25 bp, Artificial sequence
  Synthetic oligonucleotide
aagggcgggctgcgcttccagccca

SEQ ID NO: 727260 - DNA, 25 bp, Artificial sequence
  Synthetic oligonucleotide
gggctgcgcttccagcccagcggtg

SEQ ID NO: 727261 - DNA, 25 bp, Artificial sequence
  Synthetic oligonucleotide
cgcttccagcccagcggtggtgcgc

SEQ ID NO: 727262 - DNA, 25 bp, Artificial sequence
  Synthetic oligonucleotide
cagcccagcggtggtgcgcgcggtc

SEQ ID NO: 727263 - DNA, 25 bp, Artificial sequence
  Synthetic oligonucleotide
agcggtggtgcgcgcggtcccgcga

SEQ ID NO: 727264 - DNA, 25 bp, Artificial sequence
  Synthetic oligonucleotide
gtgcgcgcggtcccgcgataccggt

SEQ ID NO: 727265 - DNA, 25 bp, Artificial sequence
  Synthetic oligonucleotide
gcggtcccgcgataccggtaggcaa

SEQ ID NO: 727266 - DNA, 25 bp, Artificial sequence
  Synthetic oligonucleotide
ccgcgataccggtaggcaagaagca

SEQ ID NO: 727267 - DNA, 25 bp, Artificial sequence
  Synthetic oligonucleotide
taccggtaggcaagaagcagcgcct

SEQ ID NO: 727268 - DNA, 25 bp, Artificial sequence
  Synthetic oligonucleotide
tcagcggagggctgcctggcgagga

SEQ ID NO: 727269 - DNA, 25 bp, Artificial sequence
  Synthetic oligonucleotide
gctgcaccctgcagcacctggaaca

SEQ ID NO: 727270 - DNA, 25 bp, Artificial sequence
  Synthetic oligonucleotide
tggttcgtcagcggagggctgcctg

SEQ ID NO: 727271 - DNA, 25 bp, Artificial sequence
  Synthetic oligonucleotide
agcgcctgaccatcgagcgcctggc

SEQ ID NO: 727272 - DNA, 25 bp, Artificial sequence
  Synthetic oligonucleotide
tgaccatcgagcgcctggcccatga

SEQ ID NO: 727273 - DNA, 25 bp, Artificial sequence
  Synthetic oligonucleotide
atcgagcgcctggcccatgacggcc

SEQ ID NO: 727274 - DNA, 25 bp, Artificial sequence
  Synthetic oligonucleotide
gcctggcccatgacggccgaggtat

SEQ ID NO: 727275 - DNA, 25 bp, Artificial sequence
  Synthetic oligonucleotide
cccatgacggccgaggtatcgccca

SEQ ID NO: 727276 - DNA, 25 bp, Artificial sequence
  Synthetic oligonucleotide
acggccgaggtatcgcccacgaggc

SEQ ID NO: 727277 - DNA, 25 bp, Artificial sequence
  Synthetic oligonucleotide
gaggtatcgcccacgaggcggggat

SEQ ID NO: 727278 - DNA, 25 bp, Artificial sequence
  Synthetic oligonucleotide
tcgcccacgaggcggggatgacctg

SEQ ID NO: 727279 - DNA, 25 bp, Artificial sequence
  Synthetic oligonucleotide
acgaggcggggatgacctggttcgt

SEQ ID NO: 727280 - DNA, 25 bp, Artificial sequence
  Synthetic oligonucleotide
cggggatgacctggttcgtcagcgg

SEQ ID NO: 727281 - DNA, 25 bp, Artificial sequence
  Synthetic oligonucleotide
tggccagaaataagggcgggctgcg

SEQ ID NO: 727282 - DNA, 25 bp, Artificial sequence
  Synthetic oligonucleotide
taggcaagaagcagcgcctgaccat

SEQ ID NO: 727283 - DNA, 25 bp, Artificial sequence
  Synthetic oligonucleotide
ggcggcggcgatcaagggttacaag

SEQ ID NO: 727284 - DNA, 25 bp, Artificial sequence
  Synthetic oligonucleotide
gatgaccgcctatggcgccgagctc

SEQ ID NO: 727285 - DNA, 25 bp, Artificial sequence
  Synthetic oligonucleotide
tgcgcggcgacatccgccccggcga

SEQ ID NO: 727286 - DNA, 25 bp, Artificial sequence
  Synthetic oligonucleotide
gcgacatccgccccggcgatacgct

SEQ ID NO: 727287 - DNA, 25 bp, Artificial sequence
  Synthetic oligonucleotide
tccgccccggcgatacgctgatcga

SEQ ID NO: 727288 - DNA, 25 bp, Artificial sequence
  Synthetic oligonucleotide
ccggcgatacgctgatcgaggctac

SEQ ID NO: 727289 - DNA, 25 bp, Artificial sequence
  Synthetic oligonucleotide
atacgctgatcgaggctacttccgg

SEQ ID NO: 727290 - DNA, 25 bp, Artificial sequence
  Synthetic oligonucleotide
tgatcgaggctacttccggcaacac

SEQ ID NO: 727291 - DNA, 25 bp, Artificial sequence
  Synthetic oligonucleotide
aggctacttccggcaacaccggcat

SEQ ID NO: 727292 - DNA, 25 bp, Artificial sequence
  Synthetic oligonucleotide
cttccggcaacaccggcatcgccct

SEQ ID NO: 727293 - DNA, 25 bp, Artificial sequence
  Synthetic oligonucleotide
gcaacaccggcatcgccctggccat

SEQ ID NO: 727294 - DNA, 25 bp, Artificial sequence
  Synthetic oligonucleotide
cccgtgccgaactgcgcggcgacat

SEQ ID NO: 727295 - DNA, 25 bp, Artificial sequence
  Synthetic oligonucleotide
tcgccctggccatggcggcggcgat

SEQ ID NO: 727296 - DNA, 25 bp, Artificial sequence
  Synthetic oligonucleotide
tgatcacccgtgccgaactgcgcgg

SEQ ID NO: 727297 - DNA, 25 bp, Artificial sequence
  Synthetic oligonucleotide
caagggttacaagatgatcctgatc

SEQ ID NO: 727298 - DNA, 25 bp, Artificial sequence
  Synthetic oligonucleotide
ttacaagatgatcctgatcatgccg

SEQ ID NO: 727299 - DNA, 25 bp, Artificial sequence
  Synthetic oligonucleotide
gatgatcctgatcatgccggacaac

SEQ ID NO: 727300 - DNA, 25 bp, Artificial sequence
  Synthetic oligonucleotide
ctgatcatgccggacaactccacgg

SEQ ID NO: 727301 - DNA, 25 bp, Artificial sequence
  Synthetic oligonucleotide
atgccggacaactccacggccgaac

SEQ ID NO: 727302 - DNA, 25 bp, Artificial sequence
  Synthetic oligonucleotide
gacaactccacggccgaacgcaagg

SEQ ID NO: 727303 - DNA, 25 bp, Artificial sequence
  Synthetic oligonucleotide
tccacggccgaacgcaaggcggcga

SEQ ID NO: 727304 - DNA, 25 bp, Artificial sequence
  Synthetic oligonucleotide
ggccgaacgcaaggcggcgatgacc

SEQ ID NO: 727305 - DNA, 25 bp, Artificial sequence
  Synthetic oligonucleotide
acgcaaggcggcgatgaccgcctat

SEQ ID NO: 727306 - DNA, 25 bp, Artificial sequence
  Synthetic oligonucleotide
ggcgatcaagggttacaagatgatc

SEQ ID NO: 727307 - DNA, 25 bp, Artificial sequence
  Synthetic oligonucleotide
ccggcatcgccctggccatggcggc

SEQ ID NO: 727308 - DNA, 25 bp, Artificial sequence
  Synthetic oligonucleotide
aaacctccaataccctgctggtgaa

SEQ ID NO: 727309 - DNA, 25 bp, Artificial sequence
  Synthetic oligonucleotide
agtacccgactatcgccgactgcgt

SEQ ID NO: 727310 - DNA, 25 bp, Artificial sequence
  Synthetic oligonucleotide
cgactatcgccgactgcgttggcaa

SEQ ID NO: 727311 - DNA, 25 bp, Artificial sequence
  Synthetic oligonucleotide
tcgccgactgcgttggcaatacccc

SEQ ID NO: 727312 - DNA, 25 bp, Artificial sequence
  Synthetic oligonucleotide
ctgggcggagcaaggttttaccgct

SEQ ID NO: 727313 - DNA, 25 bp, Artificial sequence
  Synthetic oligonucleotide
ccctgcagcacctggaacacggcga

SEQ ID NO: 727314 - DNA, 25 bp, Artificial sequence
  Synthetic oligonucleotide
actgcgttggcaatacccctctggt

SEQ ID NO: 727315 - DNA, 25 bp, Artificial sequence
  Synthetic oligonucleotide
ttggcaatacccctctggtgcgtct

SEQ ID NO: 727316 - DNA, 25 bp, Artificial sequence
  Synthetic oligonucleotide
atacccctctggtgcgtctgcagcg

SEQ ID NO: 727317 - DNA, 25 bp, Artificial sequence
  Synthetic oligonucleotide
ctctggtgcgtctgcagcgccttcc

SEQ ID NO: 727318 - DNA, 25 bp, Artificial sequence
  Synthetic oligonucleotide
tgcgtctgcagcgccttcccgggga

SEQ ID NO: 727319 - DNA, 25 bp, Artificial sequence
  Synthetic oligonucleotide
ccgaactgcgcggcgacatccgccc

SEQ ID NO: 727320 - DNA, 25 bp, Artificial sequence
  Synthetic oligonucleotide
cggggaaacctccaataccctgctg

SEQ ID NO: 727321 - DNA, 25 bp, Artificial sequence
  Synthetic oligonucleotide
gcctatggcgccgagctcattctgg

SEQ ID NO: 727322 - DNA, 25 bp, Artificial sequence
  Synthetic oligonucleotide
ccaataccctgctggtgaagctcga

SEQ ID NO: 727323 - DNA, 25 bp, Artificial sequence
  Synthetic oligonucleotide
ccctgctggtgaagctcgaaggcaa

SEQ ID NO: 727324 - DNA, 25 bp, Artificial sequence
  Synthetic oligonucleotide
tggtgaagctcgaaggcaacaaccc

SEQ ID NO: 727325 - DNA, 25 bp, Artificial sequence
  Synthetic oligonucleotide
agctcgaaggcaacaacccggcggg

SEQ ID NO: 727326 - DNA, 25 bp, Artificial sequence
  Synthetic oligonucleotide
aggcaacaacccggcgggatcggtg

SEQ ID NO: 727327 - DNA, 25 bp, Artificial sequence
  Synthetic oligonucleotide
atcggtgaaggaccgcccggccctg

SEQ ID NO: 727328 - DNA, 25 bp, Artificial sequence
  Synthetic oligonucleotide
tgaaggaccgcccggccctgtcgat

SEQ ID NO: 727329 - DNA, 25 bp, Artificial sequence
  Synthetic oligonucleotide
accgcccggccctgtcgatgatcac

SEQ ID NO: 727330 - DNA, 25 bp, Artificial sequence
  Synthetic oligonucleotide
cggccctgtcgatgatcacccgtgc

SEQ ID NO: 727331 - DNA, 25 bp, Artificial sequence
  Synthetic oligonucleotide
tgtcgatgatcacccgtgccgaact

SEQ ID NO: 727332 - DNA, 25 bp, Artificial sequence
  Synthetic oligonucleotide
tgcagcgccttcccggggaaacctc

SEQ ID NO: 727333 - DNA, 25 bp, Artificial sequence
  Synthetic oligonucleotide
tctcgcgctacctcaaggagcagaa

SEQ ID NO: 727334 - DNA, 25 bp, Artificial sequence
  Synthetic oligonucleotide
ggcggcgatgaccgcctatggcgcc

SEQ ID NO: 727335 - DNA, 25 bp, Artificial sequence
  Synthetic oligonucleotide
cagaccggcggcagcatcacccatt

SEQ ID NO: 727336 - DNA, 25 bp, Artificial sequence
  Synthetic oligonucleotide
ggcggcagcatcacccatttcgtca

SEQ ID NO: 727337 - DNA, 25 bp, Artificial sequence
  Synthetic oligonucleotide
agcatcacccatttcgtcagctcca

SEQ ID NO: 727338 - DNA, 25 bp, Artificial sequence
  Synthetic oligonucleotide
cacccatttcgtcagctccatgggc

SEQ ID NO: 727339 - DNA, 25 bp, Artificial sequence
  Synthetic oligonucleotide
atttcgtcagctccatgggcaccac

SEQ ID NO: 727340 - DNA, 25 bp, Artificial sequence
  Synthetic oligonucleotide
tcagctccatgggcaccaccgggac

SEQ ID NO: 727341 - DNA, 25 bp, Artificial sequence
  Synthetic oligonucleotide
ccatgggcaccaccgggaccatcat

SEQ ID NO: 727342 - DNA, 25 bp, Artificial sequence
  Synthetic oligonucleotide
gcaccaccgggaccatcatgggcgt

SEQ ID NO: 727343 - DNA, 25 bp, Artificial sequence
  Synthetic oligonucleotide
ccgggaccatcatgggcgtctcgcg

SEQ ID NO: 727344 - DNA, 25 bp, Artificial sequence
  Synthetic oligonucleotide
gaaatctggcagcagaccggcggca

SEQ ID NO: 727345 - DNA, 25 bp, Artificial sequence
  Synthetic oligonucleotide
tgggcgtctcgcgctacctcaagga

SEQ ID NO: 727346 - DNA, 25 bp, Artificial sequence
  Synthetic oligonucleotide
ggcccggaaatctggcagcagaccg

SEQ ID NO: 727347 - DNA, 25 bp, Artificial sequence
  Synthetic oligonucleotide
gctacctcaaggagcagaacccggc

SEQ ID NO: 727348 - DNA, 25 bp, Artificial sequence
  Synthetic oligonucleotide
tcaaggagcagaacccggcggtgca

SEQ ID NO: 727349 - DNA, 25 bp, Artificial sequence
  Synthetic oligonucleotide
gcagaacccggcggtgcagatcgtc

SEQ ID NO: 727350 - DNA, 25 bp, Artificial sequence
  Synthetic oligonucleotide
acccggcggtgcagatcgtcggcct

SEQ ID NO: 727351 - DNA, 25 bp, Artificial sequence
  Synthetic oligonucleotide
cggtgcagatcgtcggcctgcaacc

SEQ ID NO: 727352 - DNA, 25 bp, Artificial sequence
  Synthetic oligonucleotide
agatcgtcggcctgcaacccatgga

SEQ ID NO: 727353 - DNA, 25 bp, Artificial sequence
  Synthetic oligonucleotide
tcggcctgcaacccatggagggctc

SEQ ID NO: 727354 - DNA, 25 bp, Artificial sequence
  Synthetic oligonucleotide
tgcaacccatggagggctcggccat

SEQ ID NO: 727355 - DNA, 25 bp, Artificial sequence
  Synthetic oligonucleotide
cccatggagggctcggccatcccgg

SEQ ID NO: 727356 - DNA, 25 bp, Artificial sequence
  Synthetic oligonucleotide
gagggctcggccatcccgggaatcc

SEQ ID NO: 727357 - DNA, 25 bp, Artificial sequence
  Synthetic oligonucleotide
ccatcatgggcgtctcgcgctacct

SEQ ID NO: 727358 - DNA, 25 bp, Artificial sequence
  Synthetic oligonucleotide
gaaggccgcggcaaggtcctcgacc

SEQ ID NO: 727359 - DNA, 25 bp, Artificial sequence
  Synthetic oligonucleotide
ggcgccgagctcattctggtcagca

SEQ ID NO: 727360 - DNA, 25 bp, Artificial sequence
  Synthetic oligonucleotide
gagctcattctggtcagcaaggaag

SEQ ID NO: 727361 - DNA, 25 bp, Artificial sequence
  Synthetic oligonucleotide
attctggtcagcaaggaagagggca

SEQ ID NO: 727362 - DNA, 25 bp, Artificial sequence
  Synthetic oligonucleotide
gtcagcaaggaagagggcatggagg

SEQ ID NO: 727363 - DNA, 25 bp, Artificial sequence
  Synthetic oligonucleotide
aaggaagagggcatggagggcgcgc

SEQ ID NO: 727364 - DNA, 25 bp, Artificial sequence
  Synthetic oligonucleotide
gagggcatggagggcgcgcgcgatc

SEQ ID NO: 727365 - DNA, 25 bp, Artificial sequence
  Synthetic oligonucleotide
atggagggcgcgcgcgatctggccg

SEQ ID NO: 727366 - DNA, 25 bp, Artificial sequence
  Synthetic oligonucleotide
gcgcgcgcgatctggccgacaagct

SEQ ID NO: 727367 - DNA, 25 bp, Artificial sequence
  Synthetic oligonucleotide
gcgatctggccgacaagctgcagcg

SEQ ID NO: 727368 - DNA, 25 bp, Artificial sequence
  Synthetic oligonucleotide
ggccgacaagctgcagcgcgaaggc

SEQ ID NO: 727369 - DNA, 25 bp, Artificial sequence
  Synthetic oligonucleotide
tggcagcagaccggcggcagcatca

SEQ ID NO: 727370 - DNA, 25 bp, Artificial sequence
  Synthetic oligonucleotide
gcagcgcgaaggccgcggcaaggtc

SEQ ID NO: 727371 - DNA, 25 bp, Artificial sequence
  Synthetic oligonucleotide
tcggccatcccgggaatccgacgct

SEQ ID NO: 727372 - DNA, 25 bp, Artificial sequence
  Synthetic oligonucleotide
cgcggcaaggtcctcgaccagttcg

SEQ ID NO: 727373 - DNA, 25 bp, Artificial sequence
  Synthetic oligonucleotide
aaggtcctcgaccagttcgccaatg

SEQ ID NO: 727374 - DNA, 25 bp, Artificial sequence
  Synthetic oligonucleotide
tcgaccagttcgccaatggcgacaa

SEQ ID NO: 727375 - DNA, 25 bp, Artificial sequence
  Synthetic oligonucleotide
agttcgccaatggcgacaacccgga

SEQ ID NO: 727376 - DNA, 25 bp, Artificial sequence
  Synthetic oligonucleotide
caatggcgacaacccggaagcccat

SEQ ID NO: 727377 - DNA, 25 bp, Artificial sequence
  Synthetic oligonucleotide
gacaacccggaagcccattaccaca

SEQ ID NO: 727378 - DNA, 25 bp, Artificial sequence
  Synthetic oligonucleotide
ccggaagcccattaccacagcaccg

SEQ ID NO: 727379 - DNA, 25 bp, Artificial sequence
  Synthetic oligonucleotide
gcccattaccacagcaccggcccgg

SEQ ID NO: 727380 - DNA, 25 bp, Artificial sequence
  Synthetic oligonucleotide
taccacagcaccggcccggaaatct

SEQ ID NO: 727381 - DNA, 25 bp, Artificial sequence
  Synthetic oligonucleotide
agcaccggcccggaaatctggcagc

SEQ ID NO: 727382 - DNA, 25 bp, Artificial sequence
  Synthetic oligonucleotide
caagctgcagcgcgaaggccgcggc

SEQ ID NO: 727383 - DNA, 25 bp, Artificial sequence
  Synthetic oligonucleotide
gttcgaggcggtacgcgaaatgagt

SEQ ID NO: 727384 - DNA, 25 bp, Artificial sequence
  Synthetic oligonucleotide
acctgtccaaagcgcttgccgaagc

SEQ ID NO: 727385 - DNA, 25 bp, Artificial sequence
  Synthetic oligonucleotide
caaagcgcttgccgaagcgccctgg

SEQ ID NO: 727386 - DNA, 25 bp, Artificial sequence
  Synthetic oligonucleotide
cgaagcgccctgggcggagcaaggt

SEQ ID NO: 727387 - DNA, 25 bp, Artificial sequence
  Synthetic oligonucleotide
ggagcaaggttttaccgctgtgctg

SEQ ID NO: 727388 - DNA, 25 bp, Artificial sequence
  Synthetic oligonucleotide
aggttttaccgctgtgctgctcgat

SEQ ID NO: 727389 - DNA, 25 bp, Artificial sequence
  Synthetic oligonucleotide
taccgctgtgctgctcgatccgccg

SEQ ID NO: 727390 - DNA, 25 bp, Artificial sequence
  Synthetic oligonucleotide
tgtgctgctcgatccgccgcgcgac

SEQ ID NO: 727391 - DNA, 25 bp, Artificial sequence
  Synthetic oligonucleotide
gctcgatccgccgcgcgacggcgcg

SEQ ID NO: 727392 - DNA, 25 bp, Artificial sequence
  Synthetic oligonucleotide
atccgccgcgcgacggcgcgttcga

SEQ ID NO: 727393 - DNA, 25 bp, Artificial sequence
  Synthetic oligonucleotide
ccgccgacgagcgggtcctcgacct

SEQ ID NO: 727394 - DNA, 25 bp, Artificial sequence
  Synthetic oligonucleotide
cggcgcgttcgaggcggtacgcgaa

SEQ ID NO: 727395 - DNA, 25 bp, Artificial sequence
  Synthetic oligonucleotide
gcgcactttttccaggccgacctgt

SEQ ID NO: 727396 - DNA, 25 bp, Artificial sequence
  Synthetic oligonucleotide
ggcggtacgcgaaatgagttctctg

SEQ ID NO: 727397 - DNA, 25 bp, Artificial sequence
  Synthetic oligonucleotide
acgcgaaatgagttctctgggtgcc

SEQ ID NO: 727398 - DNA, 25 bp, Artificial sequence
  Synthetic oligonucleotide
aaatgagttctctgggtgcccggag

SEQ ID NO: 727399 - DNA, 25 bp, Artificial sequence
  Synthetic oligonucleotide
agttctctgggtgcccggagggtag

SEQ ID NO: 727400 - DNA, 25 bp, Artificial sequence
  Synthetic oligonucleotide
ctgggtgcccggagggtagtctatg

SEQ ID NO: 727401 - DNA, 25 bp, Artificial sequence
  Synthetic oligonucleotide
gcccggagggtagtctatgtatcct

SEQ ID NO: 727402 - DNA, 25 bp, Artificial sequence
  Synthetic oligonucleotide
agggtagtctatgtatcctgcaatc

SEQ ID NO: 727403 - DNA, 25 bp, Artificial sequence
  Synthetic oligonucleotide
gtctatgtatcctgcaatccggcga

SEQ ID NO: 727404 - DNA, 25 bp, Artificial sequence
  Synthetic oligonucleotide
gtatcctgcaatccggcgaccctgg

SEQ ID NO: 727405 - DNA, 25 bp, Artificial sequence
  Synthetic oligonucleotide
tgcaatccggcgaccctggcgcgcg

SEQ ID NO: 727406 - DNA, 25 bp, Artificial sequence
  Synthetic oligonucleotide
gcgcgacggcgcgttcgaggcggta

SEQ ID NO: 727407 - DNA, 25 bp, Artificial sequence
  Synthetic oligonucleotide
gggcgtggcggcgatggtcgagcgg

SEQ ID NO: 727408 - DNA, 25 bp, Artificial sequence
  Synthetic oligonucleotide
gcttgccgaagcgccctgggcggag

SEQ ID NO: 727409 - DNA, 25 bp, Artificial sequence
  Synthetic oligonucleotide
gggtcctcgacctgttctgcgggct

SEQ ID NO: 727410 - DNA, 25 bp, Artificial sequence
  Synthetic oligonucleotide
tcgacctgttctgcgggctgggcaa

SEQ ID NO: 727411 - DNA, 25 bp, Artificial sequence
  Synthetic oligonucleotide
tgttctgcgggctgggcaatttctc

SEQ ID NO: 727412 - DNA, 25 bp, Artificial sequence
  Synthetic oligonucleotide
gcgggctgggcaatttctccctgcc

SEQ ID NO: 727413 - DNA, 25 bp, Artificial sequence
  Synthetic oligonucleotide
tgggcaatttctccctgccgctggc

SEQ ID NO: 727414 - DNA, 25 bp, Artificial sequence
  Synthetic oligonucleotide
atttctccctgccgctggcgcgccg

SEQ ID NO: 727415 - DNA, 25 bp, Artificial sequence
  Synthetic oligonucleotide
tccctgccgctggcgcgccgggtgg

SEQ ID NO: 727416 - DNA, 25 bp, Artificial sequence
  Synthetic oligonucleotide
cgctggcgcgccgggtggcgcgggt

SEQ ID NO: 727417 - DNA, 25 bp, Artificial sequence
  Synthetic oligonucleotide
gcgcgccgggtggcgcgggtagtcg

SEQ ID NO: 727418 - DNA, 25 bp, Artificial sequence
  Synthetic oligonucleotide
aggccgacctgtccaaagcgcttgc

SEQ ID NO: 727419 - DNA, 25 bp, Artificial sequence
  Synthetic oligonucleotide
gggtggagggcgtggcggcgatggt

SEQ ID NO: 727420 - DNA, 25 bp, Artificial sequence
  Synthetic oligonucleotide
ttttccaggccgacctgtccaaagc

SEQ ID NO: 727421 - DNA, 25 bp, Artificial sequence
  Synthetic oligonucleotide
ggcggcgatggtcgagcgggcaggc

SEQ ID NO: 727422 - DNA, 25 bp, Artificial sequence
  Synthetic oligonucleotide
gatggtcgagcgggcaggcgccaac

SEQ ID NO: 727423 - DNA, 25 bp, Artificial sequence
  Synthetic oligonucleotide
cgagcgggcaggcgccaacgcgctg

SEQ ID NO: 727424 - DNA, 25 bp, Artificial sequence
  Synthetic oligonucleotide
ggcaggcgccaacgcgctggccaat

SEQ ID NO: 727425 - DNA, 25 bp, Artificial sequence
  Synthetic oligonucleotide
cgccaacgcgctggccaatggcctt

SEQ ID NO: 727426 - DNA, 25 bp, Artificial sequence
  Synthetic oligonucleotide
gcgctggccaatggccttggcaacg

SEQ ID NO: 727427 - DNA, 25 bp, Artificial sequence
  Synthetic oligonucleotide
gccaatggccttggcaacgcgcact

SEQ ID NO: 727428 - DNA, 25 bp, Artificial sequence
  Synthetic oligonucleotide
tggccttggcaacgcgcactttttc

SEQ ID NO: 727429 - DNA, 25 bp, Artificial sequence
  Synthetic oligonucleotide
tggcaacgcgcactttttccaggcc

SEQ ID NO: 727430 - DNA, 25 bp, Artificial sequence
  Synthetic oligonucleotide
gcgcgcgatgctggcgaaatggcca

SEQ ID NO: 727431 - DNA, 25 bp, Artificial sequence
  Synthetic oligonucleotide
tagtcggggtggagggcgtggcggc

SEQ ID NO: 727432 - DNA, 25 bp, Artificial sequence
  Synthetic oligonucleotide
cagccggtcaacaccgacggcagta

SEQ ID NO: 727433 - DNA, 25 bp, Artificial sequence
  Synthetic oligonucleotide
tccggcgaccctggcgcgcgatgct

SEQ ID NO: 727434 - DNA, 25 bp, Artificial sequence
  Synthetic oligonucleotide
agtcatcggtgggctacgcgcaccg

SEQ ID NO: 727435 - DNA, 25 bp, Artificial sequence
  Synthetic oligonucleotide
cggtgggctacgcgcaccgtggtaa

SEQ ID NO: 727436 - DNA, 25 bp, Artificial sequence
  Synthetic oligonucleotide
gctacgcgcaccgtggtaaagggta

SEQ ID NO: 727437 - DNA, 25 bp, Artificial sequence
  Synthetic oligonucleotide
cgcaccgtggtaaagggtaggcaag

SEQ ID NO: 727438 - DNA, 25 bp, Artificial sequence
  Synthetic oligonucleotide
gtggtaaagggtaggcaagatggta

SEQ ID NO: 727439 - DNA, 25 bp, Artificial sequence
  Synthetic oligonucleotide
aagggtaggcaagatggtacaggtg

SEQ ID NO: 727440 - DNA, 25 bp, Artificial sequence
  Synthetic oligonucleotide
aggcaagatggtacaggtgagagcg

SEQ ID NO: 727441 - DNA, 25 bp, Artificial sequence
  Synthetic oligonucleotide
gatggtacaggtgagagcgcaccag

SEQ ID NO: 727442 - DNA, 25 bp, Artificial sequence
  Synthetic oligonucleotide
acaggtgagagcgcaccagccggtc

SEQ ID NO: 727443 - DNA, 25 bp, Artificial sequence
  Synthetic oligonucleotide
aaggctggcgcagtcatcggtgggc

SEQ ID NO: 727444 - DNA, 25 bp, Artificial sequence
  Synthetic oligonucleotide
gcgcaccagccggtcaacaccgacg

SEQ ID NO: 727445 - DNA, 25 bp, Artificial sequence
  Synthetic oligonucleotide
cgttcgaaggctggcgcagtcatcg

SEQ ID NO: 727446 - DNA, 25 bp, Artificial sequence
  Synthetic oligonucleotide
ggtcaacaccgacggcagtatcaac

SEQ ID NO: 727447 - DNA, 25 bp, Artificial sequence
  Synthetic oligonucleotide
caccgacggcagtatcaacctcgag

SEQ ID NO: 727448 - DNA, 25 bp, Artificial sequence
  Synthetic oligonucleotide
acggcagtatcaacctcgaggcctg

SEQ ID NO: 727449 - DNA, 25 bp, Artificial sequence
  Synthetic oligonucleotide
gtatcaacctcgaggcctggctgga

SEQ ID NO: 727450 - DNA, 25 bp, Artificial sequence
  Synthetic oligonucleotide
acctcgaggcctggctggaccacgt

SEQ ID NO: 727451 - DNA, 25 bp, Artificial sequence
  Synthetic oligonucleotide
aggcctggctggaccacgtccagaa

SEQ ID NO: 727452 - DNA, 25 bp, Artificial sequence
  Synthetic oligonucleotide
gctggaccacgtccagaacctcgtc

SEQ ID NO: 727453 - DNA, 25 bp, Artificial sequence
  Synthetic oligonucleotide
accgtgcagtacccgactatcgccg

SEQ ID NO: 727454 - DNA, 25 bp, Artificial sequence
  Synthetic oligonucleotide
gtcgatttcgaagcgggcttcagcc

SEQ ID NO: 727455 - DNA, 25 bp, Artificial sequence
  Synthetic oligonucleotide
tccagaacctcgtccccgggctcga

SEQ ID NO: 727456 - DNA, 25 bp, Artificial sequence
  Synthetic oligonucleotide
tgagagcgcaccagccggtcaacac

SEQ ID NO: 727457 - DNA, 25 bp, Artificial sequence
  Synthetic oligonucleotide
agaccgcacatgtcgaggccatggc

SEQ ID NO: 727458 - DNA, 25 bp, Artificial sequence
  Synthetic oligonucleotide
cgccgaccgccgacgagcgggtcct

SEQ ID NO: 727459 - DNA, 25 bp, Artificial sequence
  Synthetic oligonucleotide
gatgctggcgaaatggccaggcagg

SEQ ID NO: 727460 - DNA, 25 bp, Artificial sequence
  Synthetic oligonucleotide
ggcgaaatggccaggcagggctatc

SEQ ID NO: 727461 - DNA, 25 bp, Artificial sequence
  Synthetic oligonucleotide
aatggccaggcagggctatcgtctg

SEQ ID NO: 727462 - DNA, 25 bp, Artificial sequence
  Synthetic oligonucleotide
caggcagggctatcgtctgaagcgc

SEQ ID NO: 727463 - DNA, 25 bp, Artificial sequence
  Synthetic oligonucleotide
ggctatcgtctgaagcgcgccggaa

SEQ ID NO: 727464 - DNA, 25 bp, Artificial sequence
  Synthetic oligonucleotide
gtctgaagcgcgccggaatcctcga

SEQ ID NO: 727465 - DNA, 25 bp, Artificial sequence
  Synthetic oligonucleotide
agcgcgccggaatcctcgatatgtt

SEQ ID NO: 727466 - DNA, 25 bp, Artificial sequence
  Synthetic oligonucleotide
ccggaatcctcgatatgtttccgca

SEQ ID NO: 727467 - DNA, 25 bp, Artificial sequence
  Synthetic oligonucleotide
tcctcgatatgtttccgcagaccgc

SEQ ID NO: 727468 - DNA, 25 bp, Artificial sequence
  Synthetic oligonucleotide
tggcgcagtcatcggtgggctacgc

SEQ ID NO: 727469 - DNA, 25 bp, Artificial sequence
  Synthetic oligonucleotide
ttccgcagaccgcacatgtcgaggc

SEQ ID NO: 727470 - DNA, 25 bp, Artificial sequence
  Synthetic oligonucleotide
accctggcgcgcgatgctggcgaaa

SEQ ID NO: 727471 - DNA, 25 bp, Artificial sequence
  Synthetic oligonucleotide
cacatgtcgaggccatggctttgtt

SEQ ID NO: 727472 - DNA, 25 bp, Artificial sequence
  Synthetic oligonucleotide
cgaggccatggctttgttcgaggca

SEQ ID NO: 727473 - DNA, 25 bp, Artificial sequence
  Synthetic oligonucleotide
ccatggctttgttcgaggcaggcta

SEQ ID NO: 727474 - DNA, 25 bp, Artificial sequence
  Synthetic oligonucleotide
ctttgttcgaggcaggctaggatgc

SEQ ID NO: 727475 - DNA, 25 bp, Artificial sequence
  Synthetic oligonucleotide
tcgaggcaggctaggatgcctgcgt

SEQ ID NO: 727476 - DNA, 25 bp, Artificial sequence
  Synthetic oligonucleotide
aggctaggatgcctgcgtaatccga

SEQ ID NO: 727477 - DNA, 25 bp, Artificial sequence
  Synthetic oligonucleotide
ggatgcctgcgtaatccgaccagcc

SEQ ID NO: 727478 - DNA, 25 bp, Artificial sequence
  Synthetic oligonucleotide
tgcgtaatccgaccagcccgttcga

SEQ ID NO: 727479 - DNA, 25 bp, Artificial sequence
  Synthetic oligonucleotide
atccgaccagcccgttcgaaggctg

SEQ ID NO: 727480 - DNA, 25 bp, Artificial sequence
  Synthetic oligonucleotide
ccagcccgttcgaaggctggcgcag

SEQ ID NO: 727481 - DNA, 25 bp, Artificial sequence
  Synthetic oligonucleotide
atatgtttccgcagaccgcacatgt

SEQ ID NO: 727482 - DNA, 25 bp, Artificial sequence
  Synthetic oligonucleotide
tggtcctggtgccgcctttgcaaac

SEQ ID NO: 727483 - DNA, 25 bp, Artificial sequence
  Synthetic oligonucleotide
cgcggcgtctggatgtcggcttccg

SEQ ID NO: 727484 - DNA, 25 bp, Artificial sequence
  Synthetic oligonucleotide
tctggatgtcggcttccgtgcctcg

SEQ ID NO: 727485 - DNA, 25 bp, Artificial sequence
  Synthetic oligonucleotide
tgtcggcttccgtgcctcggccagc

SEQ ID NO: 727486 - DNA, 25 bp, Artificial sequence
  Synthetic oligonucleotide
cttccgtgcctcggccagccaggag

SEQ ID NO: 727487 - DNA, 25 bp, Artificial sequence
  Synthetic oligonucleotide
gtgcctcggccagccaggagatcgt

SEQ ID NO: 727488 - DNA, 25 bp, Artificial sequence
  Synthetic oligonucleotide
cggccagccaggagatcgtcgcctt

SEQ ID NO: 727489 - DNA, 25 bp, Artificial sequence
  Synthetic oligonucleotide
gccaggagatcgtcgccttcgatga

SEQ ID NO: 727490 - DNA, 25 bp, Artificial sequence
  Synthetic oligonucleotide
agatcgtcgccttcgatgagtgcct

SEQ ID NO: 727491 - DNA, 25 bp, Artificial sequence
  Synthetic oligonucleotide
tcgccttcgatgagtgcctggtcct

SEQ ID NO: 727492 - DNA, 25 bp, Artificial sequence
  Synthetic oligonucleotide
acgagcgggtcctcgacctgttctg

SEQ ID NO: 727493 - DNA, 25 bp, Artificial sequence
  Synthetic oligonucleotide
agtgcctggtcctggtgccgccttt

SEQ ID NO: 727494 - DNA, 25 bp, Artificial sequence
  Synthetic oligonucleotide
gtgcgctgggatgccagggcgcggc

SEQ ID NO: 727495 - DNA, 25 bp, Artificial sequence
  Synthetic oligonucleotide
tggtgccgcctttgcaaacgattgc

SEQ ID NO: 727496 - DNA, 25 bp, Artificial sequence
  Synthetic oligonucleotide
cgcctttgcaaacgattgcccgtgc

SEQ ID NO: 727497 - DNA, 25 bp, Artificial sequence
  Synthetic oligonucleotide
ttgcaaacgattgcccgtgccctgc

SEQ ID NO: 727498 - DNA, 25 bp, Artificial sequence
  Synthetic oligonucleotide
acgattgcccgtgccctgcctgctc

SEQ ID NO: 727499 - DNA, 25 bp, Artificial sequence
  Synthetic oligonucleotide
tgcccgtgccctgcctgctcttctg

SEQ ID NO: 727500 - DNA, 25 bp, Artificial sequence
  Synthetic oligonucleotide
gtgccctgcctgctcttctgcagga

SEQ ID NO: 727501 - DNA, 25 bp, Artificial sequence
  Synthetic oligonucleotide
tgcctgctcttctgcaggacttccg

SEQ ID NO: 727502 - DNA, 25 bp, Artificial sequence
  Synthetic oligonucleotide
tcttctgcaggacttccgcaagccg

SEQ ID NO: 727503 - DNA, 25 bp, Artificial sequence
  Synthetic oligonucleotide
caggacttccgcaagccggaaagca

SEQ ID NO: 727504 - DNA, 25 bp, Artificial sequence
  Synthetic oligonucleotide
ttccgcaagccggaaagcatcggcc

SEQ ID NO: 727505 - DNA, 25 bp, Artificial sequence
  Synthetic oligonucleotide
ttcgatgagtgcctggtcctggtgc

SEQ ID NO: 727506 - DNA, 25 bp, Artificial sequence
  Synthetic oligonucleotide
agccggaagaatgggccgcccctct

SEQ ID NO: 727507 - DNA, 25 bp, Artificial sequence
  Synthetic oligonucleotide
tggaacacggcgagcagttggccct

SEQ ID NO: 727508 - DNA, 25 bp, Artificial sequence
  Synthetic oligonucleotide
acggcgagcagttggccctgaagca

SEQ ID NO: 727509 - DNA, 25 bp, Artificial sequence
  Synthetic oligonucleotide
agcagttggccctgaagcagcgtac

SEQ ID NO: 727510 - DNA, 25 bp, Artificial sequence
  Synthetic oligonucleotide
tggccctgaagcagcgtaccttgca

SEQ ID NO: 727511 - DNA, 25 bp, Artificial sequence
  Synthetic oligonucleotide
tgaagcagcgtaccttgcaggagca

SEQ ID NO: 727512 - DNA, 25 bp, Artificial sequence
  Synthetic oligonucleotide
agcgtaccttgcaggagcagttgca

SEQ ID NO: 727513 - DNA, 25 bp, Artificial sequence
  Synthetic oligonucleotide
ccttgcaggagcagttgcagcgttt

SEQ ID NO: 727514 - DNA, 25 bp, Artificial sequence
  Synthetic oligonucleotide
aggagcagttgcagcgtttcgccgg

SEQ ID NO: 727515 - DNA, 25 bp, Artificial sequence
  Synthetic oligonucleotide
agttgcagcgtttcgccgggatcga

SEQ ID NO: 727516 - DNA, 25 bp, Artificial sequence
  Synthetic oligonucleotide
gcgtttcgccgggatcgagccggaa

SEQ ID NO: 727517 - DNA, 25 bp, Artificial sequence
  Synthetic oligonucleotide
ccagggcgcggcgtctggatgtcgg

SEQ ID NO: 727518 - DNA, 25 bp, Artificial sequence
  Synthetic oligonucleotide
gatcgagccggaagaatgggccgcc

SEQ ID NO: 727519 - DNA, 25 bp, Artificial sequence
  Synthetic oligonucleotide
tgggatgccagggcgcggcgtctgg

SEQ ID NO: 727520 - DNA, 25 bp, Artificial sequence
  Synthetic oligonucleotide
aagaatgggccgcccctctggtcgg

SEQ ID NO: 727521 - DNA, 25 bp, Artificial sequence
  Synthetic oligonucleotide
cctctggtcgggcccgaattcggct

SEQ ID NO: 727522 - DNA, 25 bp, Artificial sequence
  Synthetic oligonucleotide
gtcgggcccgaattcggctatcggc

SEQ ID NO: 727523 - DNA, 25 bp, Artificial sequence
  Synthetic oligonucleotide
cccgaattcggctatcggcgccgcg

SEQ ID NO: 727524 - DNA, 25 bp, Artificial sequence
  Synthetic oligonucleotide
attcggctatcggcgccgcgctcgg

SEQ ID NO: 727525 - DNA, 25 bp, Artificial sequence
  Synthetic oligonucleotide
gctatcggcgccgcgctcggatcgc

SEQ ID NO: 727526 - DNA, 25 bp, Artificial sequence
  Synthetic oligonucleotide
gcgccgcgctcggatcgccgtgcgc

SEQ ID NO: 727527 - DNA, 25 bp, Artificial sequence
  Synthetic oligonucleotide
gctcggatcgccgtgcgctgggatg

SEQ ID NO: 727528 - DNA, 25 bp, Artificial sequence
  Synthetic oligonucleotide
atcgccgtgcgctgggatgccaggg

SEQ ID NO: 727529 - DNA, 25 bp, Artificial sequence
  Synthetic oligonucleotide
catcggccacgtggagctcttccat

SEQ ID NO: 727530 - DNA, 25 bp, Artificial sequence
  Synthetic oligonucleotide
cgccgggatcgagccggaagaatgg

SEQ ID NO: 727531 - DNA, 25 bp, Artificial sequence
  Synthetic oligonucleotide
agacttcgtccaggtcaatgcgccg

SEQ ID NO: 727532 - DNA, 25 bp, Artificial sequence
  Synthetic oligonucleotide
aagccggaaagcatcggccacgtgg

SEQ ID NO: 727533 - DNA, 25 bp, Artificial sequence
  Synthetic oligonucleotide
tggagccggccgccgaactgggcta

SEQ ID NO: 727534 - DNA, 25 bp, Artificial sequence
  Synthetic oligonucleotide
cggccgccgaactgggctactcctt

SEQ ID NO: 727535 - DNA, 25 bp, Artificial sequence
  Synthetic oligonucleotide
ccgaactgggctactccttgggtga

SEQ ID NO: 727536 - DNA, 25 bp, Artificial sequence
  Synthetic oligonucleotide
tgggctactccttgggtgactggca

SEQ ID NO: 727537 - DNA, 25 bp, Artificial sequence
  Synthetic oligonucleotide
actccttgggtgactggcaactgac

SEQ ID NO: 727538 - DNA, 25 bp, Artificial sequence
  Synthetic oligonucleotide
tgggtgactggcaactgactctggc

SEQ ID NO: 727539 - DNA, 25 bp, Artificial sequence
  Synthetic oligonucleotide
actggcaactgactctggcataccg

SEQ ID NO: 727540 - DNA, 25 bp, Artificial sequence
  Synthetic oligonucleotide
aactgactctggcataccgacccgg

SEQ ID NO: 727541 - DNA, 25 bp, Artificial sequence
  Synthetic oligonucleotide
ctctggcataccgacccggagactt

SEQ ID NO: 727542 - DNA, 25 bp, Artificial sequence
  Synthetic oligonucleotide
agcccttgccggtggagccggccgc

SEQ ID NO: 727543 - DNA, 25 bp, Artificial sequence
  Synthetic oligonucleotide
acccggagacttcgtccaggtcaat

SEQ ID NO: 727544 - DNA, 25 bp, Artificial sequence
  Synthetic oligonucleotide
cggaacagcccttgccggtggagcc

SEQ ID NO: 727545 - DNA, 25 bp, Artificial sequence
  Synthetic oligonucleotide
cgtccaggtcaatgcgccggtgaac

SEQ ID NO: 727546 - DNA, 25 bp, Artificial sequence
  Synthetic oligonucleotide
gtcaatgcgccggtgaacgagtcga

SEQ ID NO: 727547 - DNA, 25 bp, Artificial sequence
  Synthetic oligonucleotide
gcgccggtgaacgagtcgatgatcc

SEQ ID NO: 727548 - DNA, 25 bp, Artificial sequence
  Synthetic oligonucleotide
gtgaacgagtcgatgatccgccagg

SEQ ID NO: 727549 - DNA, 25 bp, Artificial sequence
  Synthetic oligonucleotide
gagtcgatgatccgccaggcccttg

SEQ ID NO: 727550 - DNA, 25 bp, Artificial sequence
  Synthetic oligonucleotide
gatgatccgccaggcccttgactgg

SEQ ID NO: 727551 - DNA, 25 bp, Artificial sequence
  Synthetic oligonucleotide
ccgccaggcccttgactggctggcg

SEQ ID NO: 727552 - DNA, 25 bp, Artificial sequence
  Synthetic oligonucleotide
aggcccttgactggctggcgccgac

SEQ ID NO: 727553 - DNA, 25 bp, Artificial sequence
  Synthetic oligonucleotide
ttgactggctggcgccgaccgccga

SEQ ID NO: 727554 - DNA, 25 bp, Artificial sequence
  Synthetic oligonucleotide
ggctggcgccgaccgccgacgagcg

SEQ ID NO: 727555 - DNA, 25 bp, Artificial sequence
  Synthetic oligonucleotide
ataccgacccggagacttcgtccag

SEQ ID NO: 727556 - DNA, 25 bp, Artificial sequence
  Synthetic oligonucleotide
acgaggatcgccagcgcctggccgc

SEQ ID NO: 727557 - DNA, 25 bp, Artificial sequence
  Synthetic oligonucleotide
agcacctggaacacggcgagcagtt

SEQ ID NO: 727558 - DNA, 25 bp, Artificial sequence
  Synthetic oligonucleotide
cacgtggagctcttccatggcacgg

SEQ ID NO: 727559 - DNA, 25 bp, Artificial sequence
  Synthetic oligonucleotide
gagctcttccatggcacggccagtg

SEQ ID NO: 727560 - DNA, 25 bp, Artificial sequence
  Synthetic oligonucleotide
ttccatggcacggccagtgcattgc

SEQ ID NO: 727561 - DNA, 25 bp, Artificial sequence
  Synthetic oligonucleotide
ggcacggccagtgcattgctgttgc

SEQ ID NO: 727562 - DNA, 25 bp, Artificial sequence
  Synthetic oligonucleotide
gccagtgcattgctgttgcggcata

SEQ ID NO: 727563 - DNA, 25 bp, Artificial sequence
  Synthetic oligonucleotide
tgcattgctgttgcggcatacgact

SEQ ID NO: 727564 - DNA, 25 bp, Artificial sequence
  Synthetic oligonucleotide
gctgttgcggcatacgactgccctg

SEQ ID NO: 727565 - DNA, 25 bp, Artificial sequence
  Synthetic oligonucleotide
gcggcatacgactgccctggtcgac

SEQ ID NO: 727566 - DNA, 25 bp, Artificial sequence
  Synthetic oligonucleotide
tacgactgccctggtcgacgaggat

SEQ ID NO: 727567 - DNA, 25 bp, Artificial sequence
  Synthetic oligonucleotide
tgccggtggagccggccgccgaact

SEQ ID NO: 727568 - DNA, 25 bp, Artificial sequence
  Synthetic oligonucleotide
tggtcgacgaggatcgccagcgcct

SEQ ID NO: 727569 - DNA, 25 bp, Artificial sequence
  Synthetic oligonucleotide
gaaagcatcggccacgtggagctct

SEQ ID NO: 727570 - DNA, 25 bp, Artificial sequence
  Synthetic oligonucleotide
atcgccagcgcctggccgctttctg

SEQ ID NO: 727571 - DNA, 25 bp, Artificial sequence
  Synthetic oligonucleotide
agcgcctggccgctttctgctccgc

SEQ ID NO: 727572 - DNA, 25 bp, Artificial sequence
  Synthetic oligonucleotide
tggccgctttctgctccgcacacca

SEQ ID NO: 727573 - DNA, 25 bp, Artificial sequence
  Synthetic oligonucleotide
ctttctgctccgcacaccaggccca

SEQ ID NO: 727574 - DNA, 25 bp, Artificial sequence
  Synthetic oligonucleotide
gctccgcacaccaggcccagctctg

SEQ ID NO: 727575 - DNA, 25 bp, Artificial sequence
  Synthetic oligonucleotide
cacaccaggcccagctctggctgca

SEQ ID NO: 727576 - DNA, 25 bp, Artificial sequence
  Synthetic oligonucleotide
aggcccagctctggctgcaaggtgc

SEQ ID NO: 727577 - DNA, 25 bp, Artificial sequence
  Synthetic oligonucleotide
agctctggctgcaaggtgcggaaca

SEQ ID NO: 727578 - DNA, 25 bp, Artificial sequence
  Synthetic oligonucleotide
tggctgcaaggtgcggaacagccct

SEQ ID NO: 727579 - DNA, 25 bp, Artificial sequence
  Synthetic oligonucleotide
aaggtgcggaacagcccttgccggt

SEQ ID NO: 727580 - DNA, 25 bp, Artificial sequence
  Synthetic oligonucleotide
tgccctggtcgacgaggatcgccag

SEQ ID NO: 727581 - DNA, 25 bp, Artificial sequence
  Synthetic oligonucleotide
ttcgaagcgggcttcagccgacagg

SEQ ID NO: 727582 - DNA, 25 bp, Artificial sequence
  Synthetic oligonucleotide
ggacgcgaaggggtacgcaatcgcg

SEQ ID NO: 727583 - DNA, 25 bp, Artificial sequence
  Synthetic oligonucleotide
gaaggggtacgcaatcgcgatctca

SEQ ID NO: 727584 - DNA, 25 bp, Artificial sequence
  Synthetic oligonucleotide
gtacgcaatcgcgatctcagcggga

SEQ ID NO: 727585 - DNA, 25 bp, Artificial sequence
  Synthetic oligonucleotide
aatcgcgatctcagcgggatgctgt

SEQ ID NO: 727586 - DNA, 25 bp, Artificial sequence
  Synthetic oligonucleotide
gatctcagcgggatgctgtcgtggc

SEQ ID NO: 727587 - DNA, 25 bp, Artificial sequence
  Synthetic oligonucleotide
cagcgggatgctgtcgtggcaggtg

SEQ ID NO: 727588 - DNA, 25 bp, Artificial sequence
  Synthetic oligonucleotide
ggatgctgtcgtggcaggtgacccc

SEQ ID NO: 727589 - DNA, 25 bp, Artificial sequence
  Synthetic oligonucleotide
tgtcgtggcaggtgacccccgacca

SEQ ID NO: 727590 - DNA, 25 bp, Artificial sequence
  Synthetic oligonucleotide
tggcaggtgacccccgaccaggtcg

SEQ ID NO: 727591 - DNA, 25 bp, Artificial sequence
  Synthetic oligonucleotide
attccggaaagctccaaggatggcg

SEQ ID NO: 727592 - DNA, 25 bp, Artificial sequence
  Synthetic oligonucleotide
caggtcgtcgatttcgaagcgggct

SEQ ID NO: 727593 - DNA, 25 bp, Artificial sequence
  Synthetic oligonucleotide
cataccgtcaacccgagccgtaccg

SEQ ID NO: 727594 - DNA, 25 bp, Artificial sequence
  Synthetic oligonucleotide
tcagccgacagggcaatatctatgc

SEQ ID NO: 727595 - DNA, 25 bp, Artificial sequence
  Synthetic oligonucleotide
gacagggcaatatctatgccggcga

SEQ ID NO: 727596 - DNA, 25 bp, Artificial sequence
  Synthetic oligonucleotide
gcaatatctatgccggcgataccca

SEQ ID NO: 727597 - DNA, 25 bp, Artificial sequence
  Synthetic oligonucleotide
tctatgccggcgatacccagaacaa

SEQ ID NO: 727598 - DNA, 25 bp, Artificial sequence
  Synthetic oligonucleotide
ccggcgatacccagaacaacaacgg

SEQ ID NO: 727599 - DNA, 25 bp, Artificial sequence
  Synthetic oligonucleotide
gatacccagaacaacaacggcaccg

SEQ ID NO: 727600 - DNA, 25 bp, Artificial sequence
  Synthetic oligonucleotide
cagaacaacaacggcaccgccaata

SEQ ID NO: 727601 - DNA, 25 bp, Artificial sequence
  Synthetic oligonucleotide
acaacggcaccgccaatacccaggg

SEQ ID NO: 727602 - DNA, 25 bp, Artificial sequence
  Synthetic oligonucleotide
gcaccgccaatacccagggactcgc

SEQ ID NO: 727603 - DNA, 25 bp, Artificial sequence
  Synthetic oligonucleotide
ccaatacccagggactcgccgacga

SEQ ID NO: 727604 - DNA, 25 bp, Artificial sequence
  Synthetic oligonucleotide
cccgaccaggtcgtcgatttcgaag

SEQ ID NO: 727605 - DNA, 25 bp, Artificial sequence
  Synthetic oligonucleotide
ttccgcgcgtacggcagcgcgaaca

SEQ ID NO: 727606 - DNA, 25 bp, Artificial sequence
  Synthetic oligonucleotide
gacccccgcggccggctcgcgaagc

SEQ ID NO: 727607 - DNA, 25 bp, Artificial sequence
  Synthetic oligonucleotide
tccaaggatggcgccacgcgccgcg

SEQ ID NO: 727608 - DNA, 25 bp, Artificial sequence
  Synthetic oligonucleotide
gatggcgccacgcgccgcgccaact

SEQ ID NO: 727609 - DNA, 25 bp, Artificial sequence
  Synthetic oligonucleotide
gccacgcgccgcgccaacttcagcc

SEQ ID NO: 727610 - DNA, 25 bp, Artificial sequence
  Synthetic oligonucleotide
cgccgcgccaacttcagccttagcg

SEQ ID NO: 727611 - DNA, 25 bp, Artificial sequence
  Synthetic oligonucleotide
gccaacttcagccttagcgggccgc

SEQ ID NO: 727612 - DNA, 25 bp, Artificial sequence
  Synthetic oligonucleotide
ttcagccttagcgggccgctgaccg

SEQ ID NO: 727613 - DNA, 25 bp, Artificial sequence
  Synthetic oligonucleotide
cttagcgggccgctgaccgaagcct

SEQ ID NO: 727614 - DNA, 25 bp, Artificial sequence
  Synthetic oligonucleotide
gggccgctgaccgaagccttgagct

SEQ ID NO: 727615 - DNA, 25 bp, Artificial sequence
  Synthetic oligonucleotide
ctgaccgaagccttgagcttccgcg

SEQ ID NO: 727616 - DNA, 25 bp, Artificial sequence
  Synthetic oligonucleotide
gtggccggacgcgaaggggtacgca

SEQ ID NO: 727617 - DNA, 25 bp, Artificial sequence
  Synthetic oligonucleotide
ttgagcttccgcgcgtacggcagcg

SEQ ID NO: 727618 - DNA, 25 bp, Artificial sequence
  Synthetic oligonucleotide
ccgagccgtaccgtggccggacgcg

SEQ ID NO: 727619 - DNA, 25 bp, Artificial sequence
  Synthetic oligonucleotide
gcgtacggcagcgcgaacaagaccg

SEQ ID NO: 727620 - DNA, 25 bp, Artificial sequence
  Synthetic oligonucleotide
ggcagcgcgaacaagaccgattcgg

SEQ ID NO: 727621 - DNA, 25 bp, Artificial sequence
  Synthetic oligonucleotide
gcgaacaagaccgattcggacgata

SEQ ID NO: 727622 - DNA, 25 bp, Artificial sequence
  Synthetic oligonucleotide
aagaccgattcggacgataccgaca

SEQ ID NO: 727623 - DNA, 25 bp, Artificial sequence
  Synthetic oligonucleotide
gattcggacgataccgacatcaacc

SEQ ID NO: 727624 - DNA, 25 bp, Artificial sequence
  Synthetic oligonucleotide
gacgataccgacatcaacctcggac

SEQ ID NO: 727625 - DNA, 25 bp, Artificial sequence
  Synthetic oligonucleotide
accgacatcaacctcggacataccg

SEQ ID NO: 727626 - DNA, 25 bp, Artificial sequence
  Synthetic oligonucleotide
atcaacctcggacataccgtcaacc

SEQ ID NO: 727627 - DNA, 25 bp, Artificial sequence
  Synthetic oligonucleotide
ctcggacataccgtcaacccgagcc

SEQ ID NO: 727628 - DNA, 25 bp, Artificial sequence
  Synthetic oligonucleotide
gacgacggtgcggagaccaaccgca

SEQ ID NO: 727629 - DNA, 25 bp, Artificial sequence
  Synthetic oligonucleotide
gaagccttgagcttccgcgcgtacg

SEQ ID NO: 727630 - DNA, 25 bp, Artificial sequence
  Synthetic oligonucleotide
gtgctgacggtgggcgcggagtgga

SEQ ID NO: 727631 - DNA, 25 bp, Artificial sequence
  Synthetic oligonucleotide
ccagggactcgccgacgacggtgcg

SEQ ID NO: 727632 - DNA, 25 bp, Artificial sequence
  Synthetic oligonucleotide
gcaagctggagaactatcgcctcag

SEQ ID NO: 727633 - DNA, 25 bp, Artificial sequence
  Synthetic oligonucleotide
ctggagaactatcgcctcagcggcg

SEQ ID NO: 727634 - DNA, 25 bp, Artificial sequence
  Synthetic oligonucleotide
aactatcgcctcagcggcgaactca

SEQ ID NO: 727635 - DNA, 25 bp, Artificial sequence
  Synthetic oligonucleotide
cgcctcagcggcgaactcaaccttc

SEQ ID NO: 727636 - DNA, 25 bp, Artificial sequence
  Synthetic oligonucleotide
agcggcgaactcaaccttccgttgc

SEQ ID NO: 727637 - DNA, 25 bp, Artificial sequence
  Synthetic oligonucleotide
gaactcaaccttccgttgcatgcgt

SEQ ID NO: 727638 - DNA, 25 bp, Artificial sequence
  Synthetic oligonucleotide
aaccttccgttgcatgcgttgttcg

SEQ ID NO: 727639 - DNA, 25 bp, Artificial sequence
  Synthetic oligonucleotide
ccgttgcatgcgttgttcgagcagg

SEQ ID NO: 727640 - DNA, 25 bp, Artificial sequence
  Synthetic oligonucleotide
catgcgttgttcgagcaggtgctga

SEQ ID NO: 727641 - DNA, 25 bp, Artificial sequence
  Synthetic oligonucleotide
cgttcagcgccagcaagctggagaa

SEQ ID NO: 727642 - DNA, 25 bp, Artificial sequence
  Synthetic oligonucleotide
gagcaggtgctgacggtgggcgcgg

SEQ ID NO: 727643 - DNA, 25 bp, Artificial sequence
  Synthetic oligonucleotide
accgttcgttcagcgccagcaagct

SEQ ID NO: 727644 - DNA, 25 bp, Artificial sequence
  Synthetic oligonucleotide
acggtgggcgcggagtggaacaagg

SEQ ID NO: 727645 - DNA, 25 bp, Artificial sequence
  Synthetic oligonucleotide
gcggagtggaacaaggaaaccctca

SEQ ID NO: 727646 - DNA, 25 bp, Artificial sequence
  Synthetic oligonucleotide
accctcaacgacccgtcctcgctca

SEQ ID NO: 727647 - DNA, 25 bp, Artificial sequence
  Synthetic oligonucleotide
aacgacccgtcctcgctcaagcagg

SEQ ID NO: 727648 - DNA, 25 bp, Artificial sequence
  Synthetic oligonucleotide
cgtcctcgctcaagcagggcttcgt

SEQ ID NO: 727649 - DNA, 25 bp, Artificial sequence
  Synthetic oligonucleotide
tcgctcaagcagggcttcgtgggaa

SEQ ID NO: 727650 - DNA, 25 bp, Artificial sequence
  Synthetic oligonucleotide
aagcagggcttcgtgggaagcgata

SEQ ID NO: 727651 - DNA, 25 bp, Artificial sequence
  Synthetic oligonucleotide
gcttcgtgggaagcgatagcttgcc

SEQ ID NO: 727652 - DNA, 25 bp, Artificial sequence
  Synthetic oligonucleotide
tgggaagcgatagcttgccggggac

SEQ ID NO: 727653 - DNA, 25 bp, Artificial sequence
  Synthetic oligonucleotide
cgggcttcagccgacagggcaatat

SEQ ID NO: 727654 - DNA, 25 bp, Artificial sequence
  Synthetic oligonucleotide
ttgttcgagcaggtgctgacggtgg

SEQ ID NO: 727655 - DNA, 25 bp, Artificial sequence
  Synthetic oligonucleotide
cagtacgactccacccgcaacaacc

SEQ ID NO: 727656 - DNA, 25 bp, Artificial sequence
  Synthetic oligonucleotide
accaacattccggaaagctccaagg

SEQ ID NO: 727657 - DNA, 25 bp, Artificial sequence
  Synthetic oligonucleotide
ggtgcggagaccaaccgcatgtatc

SEQ ID NO: 727658 - DNA, 25 bp, Artificial sequence
  Synthetic oligonucleotide
gagaccaaccgcatgtatcgcgaga

SEQ ID NO: 727659 - DNA, 25 bp, Artificial sequence
  Synthetic oligonucleotide
aaccgcatgtatcgcgagaactacg

SEQ ID NO: 727660 - DNA, 25 bp, Artificial sequence
  Synthetic oligonucleotide
atgtatcgcgagaactacgccatca

SEQ ID NO: 727661 - DNA, 25 bp, Artificial sequence
  Synthetic oligonucleotide
tcgcgagaactacgccatcacccac

SEQ ID NO: 727662 - DNA, 25 bp, Artificial sequence
  Synthetic oligonucleotide
gaactacgccatcacccacaacggg

SEQ ID NO: 727663 - DNA, 25 bp, Artificial sequence
  Synthetic oligonucleotide
cgccatcacccacaacgggacctgg

SEQ ID NO: 727664 - DNA, 25 bp, Artificial sequence
  Synthetic oligonucleotide
tcggtacttccaggttcgtcgccca

SEQ ID NO: 727665 - DNA, 25 bp, Artificial sequence
  Synthetic oligonucleotide
cttccaggttcgtcgcccagtacga

SEQ ID NO: 727666 - DNA, 25 bp, Artificial sequence
  Synthetic oligonucleotide
gcgccagcaagctggagaactatcg

SEQ ID NO: 727667 - DNA, 25 bp, Artificial sequence
  Synthetic oligonucleotide
gtcgcccagtacgactccacccgca

SEQ ID NO: 727668 - DNA, 25 bp, Artificial sequence
  Synthetic oligonucleotide
actcgccgacgacggtgcggagacc

SEQ ID NO: 727669 - DNA, 25 bp, Artificial sequence
  Synthetic oligonucleotide
gactccacccgcaacaaccgtctgg

SEQ ID NO: 727670 - DNA, 25 bp, Artificial sequence
  Synthetic oligonucleotide
acccgcaacaaccgtctggaggagg

SEQ ID NO: 727671 - DNA, 25 bp, Artificial sequence
  Synthetic oligonucleotide
aacaaccgtctggaggaggggctgg

SEQ ID NO: 727672 - DNA, 25 bp, Artificial sequence
  Synthetic oligonucleotide
ccgtctggaggaggggctggccggt

SEQ ID NO: 727673 - DNA, 25 bp, Artificial sequence
  Synthetic oligonucleotide
ggctggccggttccgtcgaggggca

SEQ ID NO: 727674 - DNA, 25 bp, Artificial sequence
  Synthetic oligonucleotide
ccggttccgtcgaggggcagatcgg

SEQ ID NO: 727675 - DNA, 25 bp, Artificial sequence
  Synthetic oligonucleotide
ccgtcgaggggcagatcggcgccga

SEQ ID NO: 727676 - DNA, 25 bp, Artificial sequence
  Synthetic oligonucleotide
aggggcagatcggcgccgaccgttc

SEQ ID NO: 727677 - DNA, 25 bp, Artificial sequence
  Synthetic oligonucleotide
agatcggcgccgaccgttcgttcag

SEQ ID NO: 727678 - DNA, 25 bp, Artificial sequence
  Synthetic oligonucleotide
gcgccgaccgttcgttcagcgccag

SEQ ID NO: 727679 - DNA, 25 bp, Artificial sequence
  Synthetic oligonucleotide
aggttcgtcgcccagtacgactcca

SEQ ID NO: 727680 - DNA, 25 bp, Artificial sequence
  Synthetic oligonucleotide
catcaggaagcgcccgccggtgaac

SEQ ID NO: 727681 - DNA, 25 bp, Artificial sequence
  Synthetic oligonucleotide
gtggtgctgggcaccgccgaacagg

SEQ ID NO: 727682 - DNA, 25 bp, Artificial sequence
  Synthetic oligonucleotide
tgggcaccgccgaacaggagctcaa

SEQ ID NO: 727683 - DNA, 25 bp, Artificial sequence
  Synthetic oligonucleotide
ccgccgaacaggagctcaagcaggc

SEQ ID NO: 727684 - DNA, 25 bp, Artificial sequence
  Synthetic oligonucleotide
aacaggagctcaagcaggcaccggg

SEQ ID NO: 727685 - DNA, 25 bp, Artificial sequence
  Synthetic oligonucleotide
agctcaagcaggcaccgggggtatc

SEQ ID NO: 727686 - DNA, 25 bp, Artificial sequence
  Synthetic oligonucleotide
gcaggcaccgggggtatccatcatc

SEQ ID NO: 727687 - DNA, 25 bp, Artificial sequence
  Synthetic oligonucleotide
accgggggtatccatcatcaccgcc

SEQ ID NO: 727688 - DNA, 25 bp, Artificial sequence
  Synthetic oligonucleotide
ggtatccatcatcaccgccgaggac

SEQ ID NO: 727689 - DNA, 25 bp, Artificial sequence
  Synthetic oligonucleotide
atcatcaccgccgaggacatcagga

SEQ ID NO: 727690 - DNA, 25 bp, Artificial sequence
  Synthetic oligonucleotide
gaaagctccaaggatggcgccacgc

SEQ ID NO: 727691 - DNA, 25 bp, Artificial sequence
  Synthetic oligonucleotide
cgaggacatcaggaagcgcccgccg

SEQ ID NO: 727692 - DNA, 25 bp, Artificial sequence
  Synthetic oligonucleotide
gtccagctgggtgacgaggtggtgc

SEQ ID NO: 727693 - DNA, 25 bp, Artificial sequence
  Synthetic oligonucleotide
aagcgcccgccggtgaacgatctct

SEQ ID NO: 727694 - DNA, 25 bp, Artificial sequence
  Synthetic oligonucleotide
cgccggtgaacgatctctccgagat

SEQ ID NO: 727695 - DNA, 25 bp, Artificial sequence
  Synthetic oligonucleotide
tgaacgatctctccgagatcatccg

SEQ ID NO: 727696 - DNA, 25 bp, Artificial sequence
  Synthetic oligonucleotide
atctctccgagatcatccgcaccat

SEQ ID NO: 727697 - DNA, 25 bp, Artificial sequence
  Synthetic oligonucleotide
cgagatcatccgcaccatgcccggg

SEQ ID NO: 727698 - DNA, 25 bp, Artificial sequence
  Synthetic oligonucleotide
catccgcaccatgcccggggtcaac

SEQ ID NO: 727699 - DNA, 25 bp, Artificial sequence
  Synthetic oligonucleotide
accatgcccggggtcaacctcaccg

SEQ ID NO: 727700 - DNA, 25 bp, Artificial sequence
  Synthetic oligonucleotide
ccggggtcaacctcaccggcaacag

SEQ ID NO: 727701 - DNA, 25 bp, Artificial sequence
  Synthetic oligonucleotide
tcaacctcaccggcaacagttccag

SEQ ID NO: 727702 - DNA, 25 bp, Artificial sequence
  Synthetic oligonucleotide
tcaccggcaacagttccagcggcca

SEQ ID NO: 727703 - DNA, 25 bp, Artificial sequence
  Synthetic oligonucleotide
accgccgaggacatcaggaagcgcc

SEQ ID NO: 727704 - DNA, 25 bp, Artificial sequence
  Synthetic oligonucleotide
cgggcaggccctggccgaggacgag

SEQ ID NO: 727705 - DNA, 25 bp, Artificial sequence
  Synthetic oligonucleotide
cctcgtccccgggctcgatcgtcag

SEQ ID NO: 727706 - DNA, 25 bp, Artificial sequence
  Synthetic oligonucleotide
tgtacccccaattccgtcgcggcca

SEQ ID NO: 727707 - DNA, 25 bp, Artificial sequence
  Synthetic oligonucleotide
ccccaattccgtcgcggccatctcg

SEQ ID NO: 727708 - DNA, 25 bp, Artificial sequence
  Synthetic oligonucleotide
ttccgtcgcggccatctcgccgctg

SEQ ID NO: 727709 - DNA, 25 bp, Artificial sequence
  Synthetic oligonucleotide
gcggccatctcgccgctgccgtcct

SEQ ID NO: 727710 - DNA, 25 bp, Artificial sequence
  Synthetic oligonucleotide
atctcgccgctgccgtccttttcgc

SEQ ID NO: 727711 - DNA, 25 bp, Artificial sequence
  Synthetic oligonucleotide
ccgctgccgtccttttcgcttcatc

SEQ ID NO: 727712 - DNA, 25 bp, Artificial sequence
  Synthetic oligonucleotide
cgtccttttcgcttcatcgagcctg

SEQ ID NO: 727713 - DNA, 25 bp, Artificial sequence
  Synthetic oligonucleotide
tttcgcttcatcgagcctgctgggc

SEQ ID NO: 727714 - DNA, 25 bp, Artificial sequence
  Synthetic oligonucleotide
ttcatcgagcctgctgggcgggcag

SEQ ID NO: 727715 - DNA, 25 bp, Artificial sequence
  Synthetic oligonucleotide
gacgaggtggtgctgggcaccgccg

SEQ ID NO: 727716 - DNA, 25 bp, Artificial sequence
  Synthetic oligonucleotide
gctgggcgggcaggccctggccgag

SEQ ID NO: 727717 - DNA, 25 bp, Artificial sequence
  Synthetic oligonucleotide
ctgggtgacgaggtggtgctgggca

SEQ ID NO: 727718 - DNA, 25 bp, Artificial sequence
  Synthetic oligonucleotide
aggccctggccgaggacgagcgcct

SEQ ID NO: 727719 - DNA, 25 bp, Artificial sequence
  Synthetic oligonucleotide
tggccgaggacgagcgcctggaaga

SEQ ID NO: 727720 - DNA, 25 bp, Artificial sequence
  Synthetic oligonucleotide
ggacgagcgcctggaagaactggac

SEQ ID NO: 727721 - DNA, 25 bp, Artificial sequence
  Synthetic oligonucleotide
gcgcctggaagaactggacgaacgc

SEQ ID NO: 727722 - DNA, 25 bp, Artificial sequence
  Synthetic oligonucleotide
gaagaactggacgaacgcgccgaat

SEQ ID NO: 727723 - DNA, 25 bp, Artificial sequence
  Synthetic oligonucleotide
ctggacgaacgcgccgaatcggtgg

SEQ ID NO: 727724 - DNA, 25 bp, Artificial sequence
  Synthetic oligonucleotide
gaacgcgccgaatcggtggtccagc

SEQ ID NO: 727725 - DNA, 25 bp, Artificial sequence
  Synthetic oligonucleotide
gccgaatcggtggtccagctgggtg

SEQ ID NO: 727726 - DNA, 25 bp, Artificial sequence
  Synthetic oligonucleotide
tcggtggtccagctgggtgacgagg

SEQ ID NO: 727727 - DNA, 25 bp, Artificial sequence
  Synthetic oligonucleotide
agcggccagcgcggcaacaaccggc

SEQ ID NO: 727728 - DNA, 25 bp, Artificial sequence
  Synthetic oligonucleotide
gagcctgctgggcgggcaggccctg

SEQ ID NO: 727729 - DNA, 25 bp, Artificial sequence
  Synthetic oligonucleotide
ggcggggtagtcaacatcatcacca

SEQ ID NO: 727730 - DNA, 25 bp, Artificial sequence
  Synthetic oligonucleotide
ggcaacagttccagcggccagcgcg

SEQ ID NO: 727731 - DNA, 25 bp, Artificial sequence
  Synthetic oligonucleotide
gccgccggaggaggtcgagcgcatc

SEQ ID NO: 727732 - DNA, 25 bp, Artificial sequence
  Synthetic oligonucleotide
ggaggaggtcgagcgcatcgaggtc

SEQ ID NO: 727733 - DNA, 25 bp, Artificial sequence
  Synthetic oligonucleotide
gtcgagcgcatcgaggtcctccgtg

SEQ ID NO: 727734 - DNA, 25 bp, Artificial sequence
  Synthetic oligonucleotide
cgcatcgaggtcctccgtgggcccg

SEQ ID NO: 727735 - DNA, 25 bp, Artificial sequence
  Synthetic oligonucleotide
cgaggtcctccgtgggcccgcggcg

SEQ ID NO: 727736 - DNA, 25 bp, Artificial sequence
  Synthetic oligonucleotide
cctccgtgggcccgcggcggcacgc

SEQ ID NO: 727737 - DNA, 25 bp, Artificial sequence
  Synthetic oligonucleotide
tgggcccgcggcggcacgctacggt

SEQ ID NO: 727738 - DNA, 25 bp, Artificial sequence
  Synthetic oligonucleotide
gcggcggcacgctacggttccggcg

SEQ ID NO: 727739 - DNA, 25 bp, Artificial sequence
  Synthetic oligonucleotide
gcacgctacggttccggcgcggcgg

SEQ ID NO: 727740 - DNA, 25 bp, Artificial sequence
  Synthetic oligonucleotide
cagcaactgggtgccgccggaggag

SEQ ID NO: 727741 - DNA, 25 bp, Artificial sequence
  Synthetic oligonucleotide
gcggcgggcggggtagtcaacatca

SEQ ID NO: 727742 - DNA, 25 bp, Artificial sequence
  Synthetic oligonucleotide
ggcgacagcaactgggtgccgccgg

SEQ ID NO: 727743 - DNA, 25 bp, Artificial sequence
  Synthetic oligonucleotide
gtagtcaacatcatcaccaagcgcc

SEQ ID NO: 727744 - DNA, 25 bp, Artificial sequence
  Synthetic oligonucleotide
aacatcatcaccaagcgcccgaccg

SEQ ID NO: 727745 - DNA, 25 bp, Artificial sequence
  Synthetic oligonucleotide
atcaccaagcgcccgaccgatcgtt

SEQ ID NO: 727746 - DNA, 25 bp, Artificial sequence
  Synthetic oligonucleotide
aagcgcccgaccgatcgtttgcgtg

SEQ ID NO: 727747 - DNA, 25 bp, Artificial sequence
  Synthetic oligonucleotide
ccgaccgatcgtttgcgtggttcca

SEQ ID NO: 727748 - DNA, 25 bp, Artificial sequence
  Synthetic oligonucleotide
gatcgtttgcgtggttccatgacgg

SEQ ID NO: 727749 - DNA, 25 bp, Artificial sequence
  Synthetic oligonucleotide
ttgcgtggttccatgacggtgttca

SEQ ID NO: 727750 - DNA, 25 bp, Artificial sequence
  Synthetic oligonucleotide
ggttccatgacggtgttcaccaaca

SEQ ID NO: 727751 - DNA, 25 bp, Artificial sequence
  Synthetic oligonucleotide
atgacggtgttcaccaacattccgg

SEQ ID NO: 727752 - DNA, 25 bp, Artificial sequence
  Synthetic oligonucleotide
gtgttcaccaacattccggaaagct

SEQ ID NO: 727753 - DNA, 25 bp, Artificial sequence
  Synthetic oligonucleotide
tccggcgcggcgggcggggtagtca

SEQ ID NO: 727754 - DNA, 25 bp, Artificial sequence
  Synthetic oligonucleotide
acggcaaaccggtcagctcgcgcaa

SEQ ID NO: 727755 - DNA, 25 bp, Artificial sequence
  Synthetic oligonucleotide
cgcggccggctcgcgaagcccgaaa

SEQ ID NO: 727756 - DNA, 25 bp, Artificial sequence
  Synthetic oligonucleotide
cagcgcggcaacaaccggcagatcg

SEQ ID NO: 727757 - DNA, 25 bp, Artificial sequence
  Synthetic oligonucleotide
ggcaacaaccggcagatcgacatcc

SEQ ID NO: 727758 - DNA, 25 bp, Artificial sequence
  Synthetic oligonucleotide
accggcagatcgacatccgcggcat

SEQ ID NO: 727759 - DNA, 25 bp, Artificial sequence
  Synthetic oligonucleotide
agatcgacatccgcggcatggggcc

SEQ ID NO: 727760 - DNA, 25 bp, Artificial sequence
  Synthetic oligonucleotide
acatccgcggcatggggccggagaa

SEQ ID NO: 727761 - DNA, 25 bp, Artificial sequence
  Synthetic oligonucleotide
gcggcatggggccggagaacaccct

SEQ ID NO: 727762 - DNA, 25 bp, Artificial sequence
  Synthetic oligonucleotide
tggggccggagaacaccctgatcct

SEQ ID NO: 727763 - DNA, 25 bp, Artificial sequence
  Synthetic oligonucleotide
cggagaacaccctgatcctggtcga

SEQ ID NO: 727764 - DNA, 25 bp, Artificial sequence
  Synthetic oligonucleotide
acaccctgatcctggtcgacggcaa

SEQ ID NO: 727765 - DNA, 25 bp, Artificial sequence
  Synthetic oligonucleotide
ctgggtgccgccggaggaggtcgag

SEQ ID NO: 727766 - DNA, 25 bp, Artificial sequence
  Synthetic oligonucleotide
tggtcgacggcaaaccggtcagctc

SEQ ID NO: 727767 - DNA, 25 bp, Artificial sequence
  Synthetic oligonucleotide
agttccagcggccagcgcggcaaca

SEQ ID NO: 727768 - DNA, 25 bp, Artificial sequence
  Synthetic oligonucleotide
aaccggtcagctcgcgcaactcggt

SEQ ID NO: 727769 - DNA, 25 bp, Artificial sequence
  Synthetic oligonucleotide
tcagctcgcgcaactcggtgcgcta

SEQ ID NO: 727770 - DNA, 25 bp, Artificial sequence
  Synthetic oligonucleotide
cgcgcaactcggtgcgctacggctg

SEQ ID NO: 727771 - DNA, 25 bp, Artificial sequence
  Synthetic oligonucleotide
aactcggtgcgctacggctggcgcg

SEQ ID NO: 727772 - DNA, 25 bp, Artificial sequence
  Synthetic oligonucleotide
gtgcgctacggctggcgcggcgaac

SEQ ID NO: 727773 - DNA, 25 bp, Artificial sequence
  Synthetic oligonucleotide
tacggctggcgcggcgaacgcgaca

SEQ ID NO: 727774 - DNA, 25 bp, Artificial sequence
  Synthetic oligonucleotide
tggcgcggcgaacgcgacacccgcg

SEQ ID NO: 727775 - DNA, 25 bp, Artificial sequence
  Synthetic oligonucleotide
ggcgaacgcgacacccgcggcgaca

SEQ ID NO: 727776 - DNA, 25 bp, Artificial sequence
  Synthetic oligonucleotide
cgcgacacccgcggcgacagcaact

SEQ ID NO: 727777 - DNA, 25 bp, Artificial sequence
  Synthetic oligonucleotide
acccgcggcgacagcaactgggtgc

SEQ ID NO: 727778 - DNA, 25 bp, Artificial sequence
  Synthetic oligonucleotide
tgatcctggtcgacggcaaaccggt

SEQ ID NO: 727779 - DNA, 25 bp, Artificial sequence
  Synthetic oligonucleotide
ctgagcgtacggggcggggtaagca

SEQ ID NO: 727780 - DNA, 25 bp, Artificial sequence
  Synthetic oligonucleotide
tcgcgaaaagaggtgggtacctatg

SEQ ID NO: 727781 - DNA, 25 bp, Artificial sequence
  Synthetic oligonucleotide
aaagaggtgggtacctatggcatct

SEQ ID NO: 727782 - DNA, 25 bp, Artificial sequence
  Synthetic oligonucleotide
gtgggtacctatggcatctggggcg

SEQ ID NO: 727783 - DNA, 25 bp, Artificial sequence
  Synthetic oligonucleotide
acctatggcatctggggcgtcagcg

SEQ ID NO: 727784 - DNA, 25 bp, Artificial sequence
  Synthetic oligonucleotide
ggcatctggggcgtcagcgccggct

SEQ ID NO: 727785 - DNA, 25 bp, Artificial sequence
  Synthetic oligonucleotide
tggggcgtcagcgccggctacacct

SEQ ID NO: 727786 - DNA, 25 bp, Artificial sequence
  Synthetic oligonucleotide
cgtcagcgccggctacaccttcagc

SEQ ID NO: 727787 - DNA, 25 bp, Artificial sequence
  Synthetic oligonucleotide
gcgccggctacaccttcagcgagaa

SEQ ID NO: 727788 - DNA, 25 bp, Artificial sequence
  Synthetic oligonucleotide
gctacaccttcagcgagaacctgag

SEQ ID NO: 727789 - DNA, 25 bp, Artificial sequence
  Synthetic oligonucleotide
gacaccggcaacccgctttcggtga

SEQ ID NO: 727790 - DNA, 25 bp, Artificial sequence
  Synthetic oligonucleotide
gcgagaacctgagcgtacggggcgg

SEQ ID NO: 727791 - DNA, 25 bp, Artificial sequence
  Synthetic oligonucleotide
gcaacacgccggtggtctcgcgaaa

SEQ ID NO: 727792 - DNA, 25 bp, Artificial sequence
  Synthetic oligonucleotide
ggcggggtaagcaacctcttcgaca

SEQ ID NO: 727793 - DNA, 25 bp, Artificial sequence
  Synthetic oligonucleotide
gtaagcaacctcttcgacaagcgcc

SEQ ID NO: 727794 - DNA, 25 bp, Artificial sequence
  Synthetic oligonucleotide
aacctcttcgacaagcgcctgtacc

SEQ ID NO: 727795 - DNA, 25 bp, Artificial sequence
  Synthetic oligonucleotide
ttcgacaagcgcctgtaccgccagg

SEQ ID NO: 727796 - DNA, 25 bp, Artificial sequence
  Synthetic oligonucleotide
aagcgcctgtaccgccagggcaact

SEQ ID NO: 727797 - DNA, 25 bp, Artificial sequence
  Synthetic oligonucleotide
ctgtaccgccagggcaactccttcg

SEQ ID NO: 727798 - DNA, 25 bp, Artificial sequence
  Synthetic oligonucleotide
cgccagggcaactccttcgacgccg

SEQ ID NO: 727799 - DNA, 25 bp, Artificial sequence
  Synthetic oligonucleotide
ggcaactccttcgacgccggcgcgg

SEQ ID NO: 727800 - DNA, 25 bp, Artificial sequence
  Synthetic oligonucleotide
tccttcgacgccggcgcggcaacct

SEQ ID NO: 727801 - DNA, 25 bp, Artificial sequence
  Synthetic oligonucleotide
acgccggcgcggcaacctacaacga

SEQ ID NO: 727802 - DNA, 25 bp, Artificial sequence
  Synthetic oligonucleotide
ccttcagcgagaacctgagcgtacg

SEQ ID NO: 727803 - DNA, 25 bp, Artificial sequence
  Synthetic oligonucleotide
tccacccaactgaccagcaccatct

SEQ ID NO: 727804 - DNA, 25 bp, Artificial sequence
  Synthetic oligonucleotide
agcgatagcttgccggggacccccg

SEQ ID NO: 727805 - DNA, 25 bp, Artificial sequence
  Synthetic oligonucleotide
cgctttcggtgatccccgagtacac

SEQ ID NO: 727806 - DNA, 25 bp, Artificial sequence
  Synthetic oligonucleotide
cggtgatccccgagtacaccctgaa

SEQ ID NO: 727807 - DNA, 25 bp, Artificial sequence
  Synthetic oligonucleotide
tccccgagtacaccctgaactcgac

SEQ ID NO: 727808 - DNA, 25 bp, Artificial sequence
  Synthetic oligonucleotide
agtacaccctgaactcgaccctgga

SEQ ID NO: 727809 - DNA, 25 bp, Artificial sequence
  Synthetic oligonucleotide
ccctgaactcgaccctggactggca

SEQ ID NO: 727810 - DNA, 25 bp, Artificial sequence
  Synthetic oligonucleotide
actcgaccctggactggcaggccag

SEQ ID NO: 727811 - DNA, 25 bp, Artificial sequence
  Synthetic oligonucleotide
ccctggactggcaggccagcgagcg

SEQ ID NO: 727812 - DNA, 25 bp, Artificial sequence
  Synthetic oligonucleotide
actggcaggccagcgagcgtctttc

SEQ ID NO: 727813 - DNA, 25 bp, Artificial sequence
  Synthetic oligonucleotide
aggccagcgagcgtctttccaccca

SEQ ID NO: 727814 - DNA, 25 bp, Artificial sequence
  Synthetic oligonucleotide
tggtctcgcgaaaagaggtgggtac

SEQ ID NO: 727815 - DNA, 25 bp, Artificial sequence
  Synthetic oligonucleotide
cgtctttccacccaactgaccagca

SEQ ID NO: 727816 - DNA, 25 bp, Artificial sequence
  Synthetic oligonucleotide
cgccggtggtctcgcgaaaagaggt

SEQ ID NO: 727817 - DNA, 25 bp, Artificial sequence
  Synthetic oligonucleotide
caactgaccagcaccatctacggcc

SEQ ID NO: 727818 - DNA, 25 bp, Artificial sequence
  Synthetic oligonucleotide
accagcaccatctacggccgccagg

SEQ ID NO: 727819 - DNA, 25 bp, Artificial sequence
  Synthetic oligonucleotide
accatctacggccgccaggagccgc

SEQ ID NO: 727820 - DNA, 25 bp, Artificial sequence
  Synthetic oligonucleotide
tacggccgccaggagccgccgaagc

SEQ ID NO: 727821 - DNA, 25 bp, Artificial sequence
  Synthetic oligonucleotide
cgccaggagccgccgaagcatggca

SEQ ID NO: 727822 - DNA, 25 bp, Artificial sequence
  Synthetic oligonucleotide
gagccgccgaagcatggcaccagcc

SEQ ID NO: 727823 - DNA, 25 bp, Artificial sequence
  Synthetic oligonucleotide
ccgaagcatggcaccagccgcaaca

SEQ ID NO: 727824 - DNA, 25 bp, Artificial sequence
  Synthetic oligonucleotide
catggcaccagccgcaacacgccgg

SEQ ID NO: 727825 - DNA, 25 bp, Artificial sequence
  Synthetic oligonucleotide
accagccgcaacacgccggtggtct

SEQ ID NO: 727826 - DNA, 25 bp, Artificial sequence
  Synthetic oligonucleotide
acaacgagccgggtcgcgcctacta

SEQ ID NO: 727827 - DNA, 25 bp, Artificial sequence
  Synthetic oligonucleotide
agcgagcgtctttccacccaactga

SEQ ID NO: 727828 - DNA, 25 bp, Artificial sequence
  Synthetic oligonucleotide
tattgcggtgctagggtccggcccc

SEQ ID NO: 727829 - DNA, 25 bp, Artificial sequence
  Synthetic oligonucleotide
gcgcggcaacctacaacgagccggg

SEQ ID NO: 727830 - DNA, 25 bp, Artificial sequence
  Synthetic oligonucleotide
tctggtcatcgcatcgcatgccgtt

SEQ ID NO: 727831 - DNA, 25 bp, Artificial sequence
  Synthetic oligonucleotide
tcatcgcatcgcatgccgtttcggg

SEQ ID NO: 727832 - DNA, 25 bp, Artificial sequence
  Synthetic oligonucleotide
gcatcgcatgccgtttcgggcggtc

SEQ ID NO: 727833 - DNA, 25 bp, Artificial sequence
  Synthetic oligonucleotide
catgccgtttcgggcggtctttcgg

SEQ ID NO: 727834 - DNA, 25 bp, Artificial sequence
  Synthetic oligonucleotide
tttcgggcggtctttcggctgaatc

SEQ ID NO: 727835 - DNA, 25 bp, Artificial sequence
  Synthetic oligonucleotide
cggtctttcggctgaatcggcatgc

SEQ ID NO: 727836 - DNA, 25 bp, Artificial sequence
  Synthetic oligonucleotide
tttcggctgaatcggcatgcatgac

SEQ ID NO: 727837 - DNA, 25 bp, Artificial sequence
  Synthetic oligonucleotide
ctgaatcggcatgcatgaccggata

SEQ ID NO: 727838 - DNA, 25 bp, Artificial sequence
  Synthetic oligonucleotide
tcggcatgcatgaccggatattgcg

SEQ ID NO: 727839 - DNA, 25 bp, Artificial sequence
  Synthetic oligonucleotide
tcttcggacgcctctggtcatcgca

SEQ ID NO: 727840 - DNA, 25 bp, Artificial sequence
  Synthetic oligonucleotide
accggatattgcggtgctagggtcc

SEQ ID NO: 727841 - DNA, 25 bp, Artificial sequence
  Synthetic oligonucleotide
gttttctcttcggacgcctctggtc

SEQ ID NO: 727842 - DNA, 25 bp, Artificial sequence
  Synthetic oligonucleotide
ccggccccagtttcccggtatcatg

SEQ ID NO: 727843 - DNA, 25 bp, Artificial sequence
  Synthetic oligonucleotide
ccagtttcccggtatcatgctcagc

SEQ ID NO: 727844 - DNA, 25 bp, Artificial sequence
  Synthetic oligonucleotide
ttcccggtatcatgctcagccttta

SEQ ID NO: 727845 - DNA, 25 bp, Artificial sequence
  Synthetic oligonucleotide
gtatcatgctcagcctttaccgtca

SEQ ID NO: 727846 - DNA, 25 bp, Artificial sequence
  Synthetic oligonucleotide
tgctcagcctttaccgtcagtgccg

SEQ ID NO: 727847 - DNA, 25 bp, Artificial sequence
  Synthetic oligonucleotide
gcctttaccgtcagtgccgaacgag

SEQ ID NO: 727848 - DNA, 25 bp, Artificial sequence
  Synthetic oligonucleotide
accgtcagtgccgaacgagtgcctc

SEQ ID NO: 727849 - DNA, 25 bp, Artificial sequence
  Synthetic oligonucleotide
agtgccgaacgagtgcctccatgac

SEQ ID NO: 727850 - DNA, 25 bp, Artificial sequence
  Synthetic oligonucleotide
gaacgagtgcctccatgaccgtgca

SEQ ID NO: 727851 - DNA, 25 bp, Artificial sequence
  Synthetic oligonucleotide
agtgcctccatgaccgtgcagtacc

SEQ ID NO: 727852 - DNA, 25 bp, Artificial sequence
  Synthetic oligonucleotide
tgcatgaccggatattgcggtgcta

SEQ ID NO: 727853 - DNA, 25 bp, Artificial sequence
  Synthetic oligonucleotide
cggcaggcgcaacgcctgtcggacc

SEQ ID NO: 727854 - DNA, 25 bp, Artificial sequence
  Synthetic oligonucleotide
aggacaaggacaccggcaacccgct

SEQ ID NO: 727855 - DNA, 25 bp, Artificial sequence
  Synthetic oligonucleotide
cgggtcgcgcctactacgtttcgat

SEQ ID NO: 727856 - DNA, 25 bp, Artificial sequence
  Synthetic oligonucleotide
gcgcctactacgtttcgatgaccac

SEQ ID NO: 727857 - DNA, 25 bp, Artificial sequence
  Synthetic oligonucleotide
actacgtttcgatgaccacctcgtt

SEQ ID NO: 727858 - DNA, 25 bp, Artificial sequence
  Synthetic oligonucleotide
tttcgatgaccacctcgttctgatc

SEQ ID NO: 727859 - DNA, 25 bp, Artificial sequence
  Synthetic oligonucleotide
tgaccacctcgttctgatcgccgcg

SEQ ID NO: 727860 - DNA, 25 bp, Artificial sequence
  Synthetic oligonucleotide
cctcgttctgatcgccgcggccaac

SEQ ID NO: 727861 - DNA, 25 bp, Artificial sequence
  Synthetic oligonucleotide
tctgatcgccgcggccaacgcgctt

SEQ ID NO: 727862 - DNA, 25 bp, Artificial sequence
  Synthetic oligonucleotide
cgccgcggccaacgcgctttcaccg

SEQ ID NO: 727863 - DNA, 25 bp, Artificial sequence
  Synthetic oligonucleotide
ggccaacgcgctttcaccggcaggc

SEQ ID NO: 727864 - DNA, 25 bp, Artificial sequence
  Synthetic oligonucleotide
gacgcctctggtcatcgcatcgcat

SEQ ID NO: 727865 - DNA, 25 bp, Artificial sequence
  Synthetic oligonucleotide
tttcaccggcaggcgcaacgcctgt

SEQ ID NO: 727866 - DNA, 25 bp, Artificial sequence
  Synthetic oligonucleotide
caacctacaacgagccgggtcgcgc

SEQ ID NO: 727867 - DNA, 25 bp, Artificial sequence
  Synthetic oligonucleotide
gcgcaacgcctgtcggacctttctt

SEQ ID NO: 727868 - DNA, 25 bp, Artificial sequence
  Synthetic oligonucleotide
cgcctgtcggacctttctttggcgt

SEQ ID NO: 727869 - DNA, 25 bp, Artificial sequence
  Synthetic oligonucleotide
tcggacctttctttggcgttggtca

SEQ ID NO: 727870 - DNA, 25 bp, Artificial sequence
  Synthetic oligonucleotide
ctttctttggcgttggtcaggcatc

SEQ ID NO: 727871 - DNA, 25 bp, Artificial sequence
  Synthetic oligonucleotide
ttggcgttggtcaggcatcggctgt

SEQ ID NO: 727872 - DNA, 25 bp, Artificial sequence
  Synthetic oligonucleotide
ttggtcaggcatcggctgtccaacg

SEQ ID NO: 727873 - DNA, 25 bp, Artificial sequence
  Synthetic oligonucleotide
aggcatcggctgtccaacgccaggt

SEQ ID NO: 727874 - DNA, 25 bp, Artificial sequence
  Synthetic oligonucleotide
tcggctgtccaacgccaggttttct

SEQ ID NO: 727875 - DNA, 25 bp, Artificial sequence
  Synthetic oligonucleotide
tgtccaacgccaggttttctcttcg

SEQ ID NO: 727876 - DNA, 25 bp, Artificial sequence
  Synthetic oligonucleotide
cgccaggttttctcttcggacgcct

SEQ ID NO: 727877 - DNA, 25 bp, Artificial sequence
  Synthetic oligonucleotide
cgcgctttcaccggcaggcgcaacg

SEQ ID NO: 727878 - DNA, 25 bp, Artificial sequence
  Synthetic oligonucleotide
acctgtaccagagcaacccgaacta

SEQ ID NO: 727879 - DNA, 25 bp, Artificial sequence
  Synthetic oligonucleotide
cttcccaaacgctcggcgaatactt

SEQ ID NO: 727880 - DNA, 25 bp, Artificial sequence
  Synthetic oligonucleotide
aaacgctcggcgaatacttcacggt

SEQ ID NO: 727881 - DNA, 25 bp, Artificial sequence
  Synthetic oligonucleotide
tcggcgaatacttcacggtcaaggc

SEQ ID NO: 727882 - DNA, 25 bp, Artificial sequence
  Synthetic oligonucleotide
aatacttcacggtcaaggccggtat

SEQ ID NO: 727883 - DNA, 25 bp, Artificial sequence
  Synthetic oligonucleotide
tcacggtcaaggccggtatcgcacg

SEQ ID NO: 727884 - DNA, 25 bp, Artificial sequence
  Synthetic oligonucleotide
tcaaggccggtatcgcacgggcctt

SEQ ID NO: 727885 - DNA, 25 bp, Artificial sequence
  Synthetic oligonucleotide
cggtatcgcacgggccttcaaggcg

SEQ ID NO: 727886 - DNA, 25 bp, Artificial sequence
  Synthetic oligonucleotide
cgcacgggccttcaaggcgcccaac

SEQ ID NO: 727887 - DNA, 25 bp, Artificial sequence
  Synthetic oligonucleotide
gggccttcaaggcgcccaacctgta

SEQ ID NO: 727888 - DNA, 25 bp, Artificial sequence
  Synthetic oligonucleotide
gcaacccgctttcggtgatccccga

SEQ ID NO: 727889 - DNA, 25 bp, Artificial sequence
  Synthetic oligonucleotide
cgcccaacctgtaccagagcaaccc

SEQ ID NO: 727890 - DNA, 25 bp, Artificial sequence
  Synthetic oligonucleotide
tggagcccgagcctgaacgcttccc

SEQ ID NO: 727891 - DNA, 25 bp, Artificial sequence
  Synthetic oligonucleotide
accagagcaacccgaactacctgct

SEQ ID NO: 727892 - DNA, 25 bp, Artificial sequence
  Synthetic oligonucleotide
agcaacccgaactacctgctctata

SEQ ID NO: 727893 - DNA, 25 bp, Artificial sequence
  Synthetic oligonucleotide
cgaactacctgctctatacccgtgg

SEQ ID NO: 727894 - DNA, 25 bp, Artificial sequence
  Synthetic oligonucleotide
acctgctctatacccgtggcaacgg

SEQ ID NO: 727895 - DNA, 25 bp, Artificial sequence
  Synthetic oligonucleotide
ctatacccgtggcaacggttgcccg

SEQ ID NO: 727896 - DNA, 25 bp, Artificial sequence
  Synthetic oligonucleotide
ccgtggcaacggttgcccgatccag

SEQ ID NO: 727897 - DNA, 25 bp, Artificial sequence
  Synthetic oligonucleotide
aacggttgcccgatccagactagca

SEQ ID NO: 727898 - DNA, 25 bp, Artificial sequence
  Synthetic oligonucleotide
tgcccgatccagactagcagcggcg

SEQ ID NO: 727899 - DNA, 25 bp, Artificial sequence
  Synthetic oligonucleotide
atccagactagcagcggcggctgct

SEQ ID NO: 727900 - DNA, 25 bp, Artificial sequence
  Synthetic oligonucleotide
actagcagcggcggctgctacctgg

SEQ ID NO: 727901 - DNA, 25 bp, Artificial sequence
  Synthetic oligonucleotide
tcaaggcgcccaacctgtaccagag

SEQ ID NO: 727902 - DNA, 25 bp, Artificial sequence
  Synthetic oligonucleotide
cccggcaccatgctcacccccgggc

SEQ ID NO: 727903 - DNA, 25 bp, Artificial sequence
  Synthetic oligonucleotide
cggctcgcgaagcccgaaaagcaag

SEQ ID NO: 727904 - DNA, 25 bp, Artificial sequence
  Synthetic oligonucleotide
cgaagcccgaaaagcaaggcggaga

SEQ ID NO: 727905 - DNA, 25 bp, Artificial sequence
  Synthetic oligonucleotide
cccgaaaagcaaggcggagatccgc

SEQ ID NO: 727906 - DNA, 25 bp, Artificial sequence
  Synthetic oligonucleotide
aaagcaaggcggagatccgcgcgct

SEQ ID NO: 727907 - DNA, 25 bp, Artificial sequence
  Synthetic oligonucleotide
aggcggagatccgcgcgctgtacgt

SEQ ID NO: 727908 - DNA, 25 bp, Artificial sequence
  Synthetic oligonucleotide
agatccgcgcgctgtacgtggaaga

SEQ ID NO: 727909 - DNA, 25 bp, Artificial sequence
  Synthetic oligonucleotide
gcgcgctgtacgtggaagacaatat

SEQ ID NO: 727910 - DNA, 25 bp, Artificial sequence
  Synthetic oligonucleotide
tgtacgtggaagacaatatcgaact

SEQ ID NO: 727911 - DNA, 25 bp, Artificial sequence
  Synthetic oligonucleotide
tggaagacaatatcgaactgcgccc

SEQ ID NO: 727912 - DNA, 25 bp, Artificial sequence
  Synthetic oligonucleotide
gacaatatcgaactgcgccccggca

SEQ ID NO: 727913 - DNA, 25 bp, Artificial sequence
  Synthetic oligonucleotide
tgaacgcttcccaaacgctcggcga

SEQ ID NO: 727914 - DNA, 25 bp, Artificial sequence
  Synthetic oligonucleotide
ctgcgccccggcaccatgctcaccc

SEQ ID NO: 727915 - DNA, 25 bp, Artificial sequence
  Synthetic oligonucleotide
cgagcctgaacgcttcccaaacgct

SEQ ID NO: 727916 - DNA, 25 bp, Artificial sequence
  Synthetic oligonucleotide
accatgctcacccccgggctgcgcc

SEQ ID NO: 727917 - DNA, 25 bp, Artificial sequence
  Synthetic oligonucleotide
tcacccccgggctgcgcctggacga

SEQ ID NO: 727918 - DNA, 25 bp, Artificial sequence
  Synthetic oligonucleotide
cgggctgcgcctggacgatcacagc

SEQ ID NO: 727919 - DNA, 25 bp, Artificial sequence
  Synthetic oligonucleotide
gcgcctggacgatcacagcgacttc

SEQ ID NO: 727920 - DNA, 25 bp, Artificial sequence
  Synthetic oligonucleotide
tggacgatcacagcgacttcggcct

SEQ ID NO: 727921 - DNA, 25 bp, Artificial sequence
  Synthetic oligonucleotide
atcacagcgacttcggcctgaactg

SEQ ID NO: 727922 - DNA, 25 bp, Artificial sequence
  Synthetic oligonucleotide
gcgacttcggcctgaactggagccc

SEQ ID NO: 727923 - DNA, 25 bp, Artificial sequence
  Synthetic oligonucleotide
ttcggcctgaactggagcccgagcc

SEQ ID NO: 727924 - DNA, 25 bp, Artificial sequence
  Synthetic oligonucleotide
ctgaactggagcccgagcctgaacg

SEQ ID NO: 727925 - DNA, 25 bp, Artificial sequence
  Synthetic oligonucleotide
tacctggtcggcaacgagaacctgg

SEQ ID NO: 727926 - DNA, 25 bp, Artificial sequence
  Synthetic oligonucleotide
atcgaactgcgccccggcaccatgc

SEQ ID NO: 727927 - DNA, 25 bp, Artificial sequence
  Synthetic oligonucleotide
acctgctggtccccctgcacgagga

SEQ ID NO: 727928 - DNA, 25 bp, Artificial sequence
  Synthetic oligonucleotide
agcggcggctgctacctggtcggca

SEQ ID NO: 727929 - DNA, 25 bp, Artificial sequence
  Synthetic oligonucleotide
gaccggcaacaacatcctgcaatgg

SEQ ID NO: 727930 - DNA, 25 bp, Artificial sequence
  Synthetic oligonucleotide
caacaacatcctgcaatggagcaac

SEQ ID NO: 727931 - DNA, 25 bp, Artificial sequence
  Synthetic oligonucleotide
catcctgcaatggagcaacgcgaag

SEQ ID NO: 727932 - DNA, 25 bp, Artificial sequence
  Synthetic oligonucleotide
gcaatggagcaacgcgaagaaagca

SEQ ID NO: 727933 - DNA, 25 bp, Artificial sequence
  Synthetic oligonucleotide
gagcaacgcgaagaaagcagtggtc

SEQ ID NO: 727934 - DNA, 25 bp, Artificial sequence
  Synthetic oligonucleotide
cgcgaagaaagcagtggtcgagggc

SEQ ID NO: 727935 - DNA, 25 bp, Artificial sequence
  Synthetic oligonucleotide
gaaagcagtggtcgagggcctggaa

SEQ ID NO: 727936 - DNA, 25 bp, Artificial sequence
  Synthetic oligonucleotide
gtggtcgagggcctggaaggcaacc

SEQ ID NO: 727937 - DNA, 25 bp, Artificial sequence
  Synthetic oligonucleotide
cgagggcctggaaggcaacctgctg

SEQ ID NO: 727938 - DNA, 25 bp, Artificial sequence
  Synthetic oligonucleotide
tgggacagaccgggaccggcaacaa

SEQ ID NO: 727939 - DNA, 25 bp, Artificial sequence
  Synthetic oligonucleotide
aaggcaacctgctggtccccctgca

SEQ ID NO: 727940 - DNA, 25 bp, Artificial sequence
  Synthetic oligonucleotide
atgtcatgggacagaccgggaccgg

SEQ ID NO: 727941 - DNA, 25 bp, Artificial sequence
  Synthetic oligonucleotide
tggtccccctgcacgaggacctgag

SEQ ID NO: 727942 - DNA, 25 bp, Artificial sequence
  Synthetic oligonucleotide
ccctgcacgaggacctgagctggag

SEQ ID NO: 727943 - DNA, 25 bp, Artificial sequence
  Synthetic oligonucleotide
acgaggacctgagctggagcaccaa

SEQ ID NO: 727944 - DNA, 25 bp, Artificial sequence
  Synthetic oligonucleotide
gacctgagctggagcaccaacctga

SEQ ID NO: 727945 - DNA, 25 bp, Artificial sequence
  Synthetic oligonucleotide
agctggagcaccaacctgacctata

SEQ ID NO: 727946 - DNA, 25 bp, Artificial sequence
  Synthetic oligonucleotide
agcaccaacctgacctatatgctgc

SEQ ID NO: 727947 - DNA, 25 bp, Artificial sequence
  Synthetic oligonucleotide
aacctgacctatatgctgcaatcca

SEQ ID NO: 727948 - DNA, 25 bp, Artificial sequence
  Synthetic oligonucleotide
acctatatgctgcaatccaaggaca

SEQ ID NO: 727949 - DNA, 25 bp, Artificial sequence
  Synthetic oligonucleotide
atgctgcaatccaaggacaaggaca

SEQ ID NO: 727950 - DNA, 25 bp, Artificial sequence
  Synthetic oligonucleotide
caatccaaggacaaggacaccggca

SEQ ID NO: 727951 - DNA, 25 bp, Artificial sequence
  Synthetic oligonucleotide
gcctggaaggcaacctgctggtccc

SEQ ID NO: 727952 - DNA, 25 bp, Artificial sequence
  Synthetic oligonucleotide
gatggctgggtcgccgggctcacct

SEQ ID NO: 727953 - DNA, 25 bp, Artificial sequence
  Synthetic oligonucleotide
tccatgaccgtgcagtacccgacta

SEQ ID NO: 727954 - DNA, 25 bp, Artificial sequence
  Synthetic oligonucleotide
gtcggcaacgagaacctggacgccg

SEQ ID NO: 727955 - DNA, 25 bp, Artificial sequence
  Synthetic oligonucleotide
aacgagaacctggacgccgagacca

SEQ ID NO: 727956 - DNA, 25 bp, Artificial sequence
  Synthetic oligonucleotide
aacctggacgccgagaccagcgtaa

SEQ ID NO: 727957 - DNA, 25 bp, Artificial sequence
  Synthetic oligonucleotide
gacgccgagaccagcgtaaacaagg

SEQ ID NO: 727958 - DNA, 25 bp, Artificial sequence
  Synthetic oligonucleotide
gagaccagcgtaaacaaggaactgg

SEQ ID NO: 727959 - DNA, 25 bp, Artificial sequence
  Synthetic oligonucleotide
agcgtaaacaaggaactgggcatcg

SEQ ID NO: 727960 - DNA, 25 bp, Artificial sequence
  Synthetic oligonucleotide
aaacaaggaactgggcatcgagttc

SEQ ID NO: 727961 - DNA, 25 bp, Artificial sequence
  Synthetic oligonucleotide
ggaactgggcatcgagttccggcgc

SEQ ID NO: 727962 - DNA, 25 bp, Artificial sequence
  Synthetic oligonucleotide
gggcatcgagttccggcgcgatggc

SEQ ID NO: 727963 - DNA, 25 bp, Artificial sequence
  Synthetic oligonucleotide
gaccgggaccggcaacaacatcctg

SEQ ID NO: 727964 - DNA, 25 bp, Artificial sequence
  Synthetic oligonucleotide
cggcgcgatggctgggtcgccgggc

SEQ ID NO: 727965 - DNA, 25 bp, Artificial sequence
  Synthetic oligonucleotide
ggctgctacctggtcggcaacgaga

SEQ ID NO: 727966 - DNA, 25 bp, Artificial sequence
  Synthetic oligonucleotide
tgggtcgccgggctcacctacttcc

SEQ ID NO: 727967 - DNA, 25 bp, Artificial sequence
  Synthetic oligonucleotide
gccgggctcacctacttccgcaacg

SEQ ID NO: 727968 - DNA, 25 bp, Artificial sequence
  Synthetic oligonucleotide
ctcacctacttccgcaacgactaca

SEQ ID NO: 727969 - DNA, 25 bp, Artificial sequence
  Synthetic oligonucleotide
tacttccgcaacgactacaagaaca

SEQ ID NO: 727970 - DNA, 25 bp, Artificial sequence
  Synthetic oligonucleotide
cgcaacgactacaagaacaagatcg

SEQ ID NO: 727971 - DNA, 25 bp, Artificial sequence
  Synthetic oligonucleotide
gactacaagaacaagatcgtcgcgc

SEQ ID NO: 727972 - DNA, 25 bp, Artificial sequence
  Synthetic oligonucleotide
aagaacaagatcgtcgcgccgctgg

SEQ ID NO: 727973 - DNA, 25 bp, Artificial sequence
  Synthetic oligonucleotide
aagatcgtcgcgccgctggatgtca

SEQ ID NO: 727974 - DNA, 25 bp, Artificial sequence
  Synthetic oligonucleotide
tcgcgccgctggatgtcatgggaca

SEQ ID NO: 727975 - DNA, 25 bp, Artificial sequence
  Synthetic oligonucleotide
cgctggatgtcatgggacagaccgg

SEQ ID NO: 727976 - DNA, 25 bp, Artificial sequence
  Synthetic oligonucleotide
gagttccggcgcgatggctgggtcg

SEQ ID NO: 727977 - DNA, 25 bp, Artificial sequence
  Synthetic oligonucleotide
tggcggagcaactgcgggtcgatat

SEQ ID NO: 727978 - DNA, 25 bp, Artificial sequence
  Synthetic oligonucleotide
ttcactcccgacggccatgccatcg

SEQ ID NO: 727979 - DNA, 25 bp, Artificial sequence
  Synthetic oligonucleotide
tacgtcttcactcccgacggccatg

SEQ ID NO: 727980 - DNA, 25 bp, Artificial sequence
  Synthetic oligonucleotide
agggtctacgtcttcactcccgacg

SEQ ID NO: 727981 - DNA, 25 bp, Artificial sequence
  Synthetic oligonucleotide
cggacagggtctacgtcttcactcc

SEQ ID NO: 727982 - DNA, 25 bp, Artificial sequence
  Synthetic oligonucleotide
tcgagccggacagggtctacgtctt

SEQ ID NO: 727983 - DNA, 25 bp, Artificial sequence
  Synthetic oligonucleotide
tcgatatcgagccggacagggtcta

SEQ ID NO: 727984 - DNA, 25 bp, Artificial sequence
  Synthetic oligonucleotide
aggtgctcgaatggcacgaggaact

SEQ ID NO: 727985 - DNA, 25 bp, Artificial sequence
  Synthetic oligonucleotide
agcaactgcgggtcgatatcgagcc

SEQ ID NO: 727986 - DNA, 25 bp, Artificial sequence
  Synthetic oligonucleotide
tgccatcgacctgcccaagggcgcg

SEQ ID NO: 727987 - DNA, 25 bp, Artificial sequence
  Synthetic oligonucleotide
gtggcctggcggagcaactgcgggt

SEQ ID NO: 727988 - DNA, 25 bp, Artificial sequence
  Synthetic oligonucleotide
acatcggtggcctggcggagcaact

SEQ ID NO: 727989 - DNA, 25 bp, Artificial sequence
  Synthetic oligonucleotide
tgggcgacatcggtggcctggcgga

SEQ ID NO: 727990 - DNA, 25 bp, Artificial sequence
  Synthetic oligonucleotide
aggaactgggcgacatcggtggcct

SEQ ID NO: 727991 - DNA, 25 bp, Artificial sequence
  Synthetic oligonucleotide
ggcacgaggaactgggcgacatcgg

SEQ ID NO: 727992 - DNA, 25 bp, Artificial sequence
  Synthetic oligonucleotide
cacattcccaaggagttcgacgact

SEQ ID NO: 727993 - DNA, 25 bp, Artificial sequence
  Synthetic oligonucleotide
tgcgggtcgatatcgagccggacag

SEQ ID NO: 727994 - DNA, 25 bp, Artificial sequence
  Synthetic oligonucleotide
tatcgggtccacactgaagtcgggc

SEQ ID NO: 727995 - DNA, 25 bp, Artificial sequence
  Synthetic oligonucleotide
aacggacgcatcgtgccgctgaact

SEQ ID NO: 727996 - DNA, 25 bp, Artificial sequence
  Synthetic oligonucleotide
aagatcaacggacgcatcgtgccgc

SEQ ID NO: 727997 - DNA, 25 bp, Artificial sequence
  Synthetic oligonucleotide
gggcgaagatcaacggacgcatcgt

SEQ ID NO: 727998 - DNA, 25 bp, Artificial sequence
  Synthetic oligonucleotide
tgccgcggggcgaagatcaacggac

SEQ ID NO: 727999 - DNA, 25 bp, Artificial sequence
  Synthetic oligonucleotide
cacaactgccgcggggcgaagatca

SEQ ID NO: 728000 - DNA, 25 bp, Artificial sequence
  Synthetic oligonucleotide
gtcgggcacaactgccgcggggcga

SEQ ID NO: 728001 - DNA, 25 bp, Artificial sequence
  Synthetic oligonucleotide
cccgacggccatgccatcgacctgc

SEQ ID NO: 728002 - DNA, 25 bp, Artificial sequence
  Synthetic oligonucleotide
gtccacactgaagtcgggcacaact

SEQ ID NO: 728003 - DNA, 25 bp, Artificial sequence
  Synthetic oligonucleotide
ggccatgccatcgacctgcccaagg

SEQ ID NO: 728004 - DNA, 25 bp, Artificial sequence
  Synthetic oligonucleotide
ttcgcctatcgggtccacactgaag

SEQ ID NO: 728005 - DNA, 25 bp, Artificial sequence
  Synthetic oligonucleotide
ctggatttcgcctatcgggtccaca

SEQ ID NO: 728006 - DNA, 25 bp, Artificial sequence
  Synthetic oligonucleotide
accccgctggatttcgcctatcggg

SEQ ID NO: 728007 - DNA, 25 bp, Artificial sequence
  Synthetic oligonucleotide
ggcgcgaccccgctggatttcgcct

SEQ ID NO: 728008 - DNA, 25 bp, Artificial sequence
  Synthetic oligonucleotide
gcccaagggcgcgaccccgctggat

SEQ ID NO: 728009 - DNA, 25 bp, Artificial sequence
  Synthetic oligonucleotide
cgacctgcccaagggcgcgaccccg

SEQ ID NO: 728010 - DNA, 25 bp, Artificial sequence
  Synthetic oligonucleotide
tgcgccaggtgctcgaatggcacga

SEQ ID NO: 728011 - DNA, 25 bp, Artificial sequence
  Synthetic oligonucleotide
actgaagtcgggcacaactgccgcg

SEQ ID NO: 728012 - DNA, 25 bp, Artificial sequence
  Synthetic oligonucleotide
cgctcgctgcataccgcagtgatcg

SEQ ID NO: 728013 - DNA, 25 bp, Artificial sequence
  Synthetic oligonucleotide
gatccgtacccactccatgcacgaa

SEQ ID NO: 728014 - DNA, 25 bp, Artificial sequence
  Synthetic oligonucleotide
agtacagatccgtacccactccatg

SEQ ID NO: 728015 - DNA, 25 bp, Artificial sequence
  Synthetic oligonucleotide
gctggaagtacagatccgtacccac

SEQ ID NO: 728016 - DNA, 25 bp, Artificial sequence
  Synthetic oligonucleotide
gaaggtgctggaagtacagatccgt

SEQ ID NO: 728017 - DNA, 25 bp, Artificial sequence
  Synthetic oligonucleotide
ccgaggggaaggtgctggaagtaca

SEQ ID NO: 728018 - DNA, 25 bp, Artificial sequence
  Synthetic oligonucleotide
tgatcggccccgaggggaaggtgct

SEQ ID NO: 728019 - DNA, 25 bp, Artificial sequence
  Synthetic oligonucleotide
tcgaatggcacgaggaactgggcga

SEQ ID NO: 728020 - DNA, 25 bp, Artificial sequence
  Synthetic oligonucleotide
tgcataccgcagtgatcggccccga

SEQ ID NO: 728021 - DNA, 25 bp, Artificial sequence
  Synthetic oligonucleotide
atgcacgaagaggcggagctcggag

SEQ ID NO: 728022 - DNA, 25 bp, Artificial sequence
  Synthetic oligonucleotide
ggctatcgctcgctgcataccgcag

SEQ ID NO: 728023 - DNA, 25 bp, Artificial sequence
  Synthetic oligonucleotide
ggaaaacggctatcgctcgctgcat

SEQ ID NO: 728024 - DNA, 25 bp, Artificial sequence
  Synthetic oligonucleotide
ccccaaggaaaacggctatcgctcg

SEQ ID NO: 728025 - DNA, 25 bp, Artificial sequence
  Synthetic oligonucleotide
gacgactacatcgccaaccccaagg

SEQ ID NO: 728026 - DNA, 25 bp, Artificial sequence
  Synthetic oligonucleotide
gagttcgacgactacatcgccaacc

SEQ ID NO: 728027 - DNA, 25 bp, Artificial sequence
  Synthetic oligonucleotide
ccccgggctcgatcgtcagggcttg

SEQ ID NO: 728028 - DNA, 25 bp, Artificial sequence
  Synthetic oligonucleotide
ccgcagtgatcggccccgaggggaa

SEQ ID NO: 728029 - DNA, 25 bp, Artificial sequence
  Synthetic oligonucleotide
aaggggaccgacgtcaaggccagct

SEQ ID NO: 728030 - DNA, 25 bp, Artificial sequence
  Synthetic oligonucleotide
cctggctgcgccaggtgctcgaatg

SEQ ID NO: 728031 - DNA, 25 bp, Artificial sequence
  Synthetic oligonucleotide
aagatctcctggctgcgccaggtgc

SEQ ID NO: 728032 - DNA, 25 bp, Artificial sequence
  Synthetic oligonucleotide
gaggaaaagatctcctggctgcgcc

SEQ ID NO: 728033 - DNA, 25 bp, Artificial sequence
  Synthetic oligonucleotide
cattacgaggaaaagatctcctggc

SEQ ID NO: 728034 - DNA, 25 bp, Artificial sequence
  Synthetic oligonucleotide
tccaaccattacgaggaaaagatct

SEQ ID NO: 728035 - DNA, 25 bp, Artificial sequence
  Synthetic oligonucleotide
gccagctccaaccattacgaggaaa

SEQ ID NO: 728036 - DNA, 25 bp, Artificial sequence
  Synthetic oligonucleotide
gtacccactccatgcacgaagaggc

SEQ ID NO: 728037 - DNA, 25 bp, Artificial sequence
  Synthetic oligonucleotide
gaccgacgtcaaggccagctccaac

SEQ ID NO: 728038 - DNA, 25 bp, Artificial sequence
  Synthetic oligonucleotide
actccatgcacgaagaggcggagct

SEQ ID NO: 728039 - DNA, 25 bp, Artificial sequence
  Synthetic oligonucleotide
gcgctacaaggggaccgacgtcaag

SEQ ID NO: 728040 - DNA, 25 bp, Artificial sequence
  Synthetic oligonucleotide
cgcactggcgctacaaggggaccga

SEQ ID NO: 728041 - DNA, 25 bp, Artificial sequence
  Synthetic oligonucleotide
gtctgcgcgcactggcgctacaagg

SEQ ID NO: 728042 - DNA, 25 bp, Artificial sequence
  Synthetic oligonucleotide
ctcggagtctgcgcgcactggcgct

SEQ ID NO: 728043 - DNA, 25 bp, Artificial sequence
  Synthetic oligonucleotide
gcggagctcggagtctgcgcgcact

SEQ ID NO: 728044 - DNA, 25 bp, Artificial sequence
  Synthetic oligonucleotide
gaagaggcggagctcggagtctgcg

SEQ ID NO: 728045 - DNA, 25 bp, Artificial sequence
  Synthetic oligonucleotide
tgaactacagcctgcagaccggcga

SEQ ID NO: 728046 - DNA, 25 bp, Artificial sequence
  Synthetic oligonucleotide
gtcaaggccagctccaaccattacg

SEQ ID NO: 728047 - DNA, 25 bp, Artificial sequence
  Synthetic oligonucleotide
ccaacgtgcgtaccgccgaggatat

SEQ ID NO: 728048 - DNA, 25 bp, Artificial sequence
  Synthetic oligonucleotide
acctgcgcttggcgcacctggtcaa

SEQ ID NO: 728049 - DNA, 25 bp, Artificial sequence
  Synthetic oligonucleotide
ccggcgacctgcgcttggcgcacct

SEQ ID NO: 728050 - DNA, 25 bp, Artificial sequence
  Synthetic oligonucleotide
ctcggcgccggcgacctgcgcttgg

SEQ ID NO: 728051 - DNA, 25 bp, Artificial sequence
  Synthetic oligonucleotide
gccgctctcggcgccggcgacctgc

SEQ ID NO: 728052 - DNA, 25 bp, Artificial sequence
  Synthetic oligonucleotide
tgttcgccgctctcggcgccggcga

SEQ ID NO: 728053 - DNA, 25 bp, Artificial sequence
  Synthetic oligonucleotide
aggatatgttcgccgctctcggcgc

SEQ ID NO: 728054 - DNA, 25 bp, Artificial sequence
  Synthetic oligonucleotide
gcatcgtgccgctgaactacagcct

SEQ ID NO: 728055 - DNA, 25 bp, Artificial sequence
  Synthetic oligonucleotide
tgcgtaccgccgaggatatgttcgc

SEQ ID NO: 728056 - DNA, 25 bp, Artificial sequence
  Synthetic oligonucleotide
ggtcaactatgcccagcaactggtc

SEQ ID NO: 728057 - DNA, 25 bp, Artificial sequence
  Synthetic oligonucleotide
agaaggccaacgtgcgtaccgccga

SEQ ID NO: 728058 - DNA, 25 bp, Artificial sequence
  Synthetic oligonucleotide
tggcggagaaggccaacgtgcgtac

SEQ ID NO: 728059 - DNA, 25 bp, Artificial sequence
  Synthetic oligonucleotide
accggctggcggagaaggccaacgt

SEQ ID NO: 728060 - DNA, 25 bp, Artificial sequence
  Synthetic oligonucleotide
atttcgaccggctggcggagaaggc

SEQ ID NO: 728061 - DNA, 25 bp, Artificial sequence
  Synthetic oligonucleotide
cggtggatttcgaccggctggcgga

SEQ ID NO: 728062 - DNA, 25 bp, Artificial sequence
  Synthetic oligonucleotide
tgccgccggtggatttcgaccggct

SEQ ID NO: 728063 - DNA, 25 bp, Artificial sequence
  Synthetic oligonucleotide
ccgccgaggatatgttcgccgctct

SEQ ID NO: 728064 - DNA, 25 bp, Artificial sequence
  Synthetic oligonucleotide
agcaactcgaactgatcccgcgcaa

SEQ ID NO: 728065 - DNA, 25 bp, Artificial sequence
  Synthetic oligonucleotide
cgcggcgacgtgcagatccagggtg

SEQ ID NO: 728066 - DNA, 25 bp, Artificial sequence
  Synthetic oligonucleotide
ggcaagcgcggcgacgtgcagatcc

SEQ ID NO: 728067 - DNA, 25 bp, Artificial sequence
  Synthetic oligonucleotide
cggccacggcaagcgcggcgacgtg

SEQ ID NO: 728068 - DNA, 25 bp, Artificial sequence
  Synthetic oligonucleotide
gcaagatcggccacggcaagcgcgg

SEQ ID NO: 728069 - DNA, 25 bp, Artificial sequence
  Synthetic oligonucleotide
agccgagcaagatcggccacggcaa

SEQ ID NO: 728070 - DNA, 25 bp, Artificial sequence
  Synthetic oligonucleotide
cgcgcaagccgagcaagatcggcca

SEQ ID NO: 728071 - DNA, 25 bp, Artificial sequence
  Synthetic oligonucleotide
gcttggcgcacctggtcaactatgc

SEQ ID NO: 728072 - DNA, 25 bp, Artificial sequence
  Synthetic oligonucleotide
tcgaactgatcccgcgcaagccgag

SEQ ID NO: 728073 - DNA, 25 bp, Artificial sequence
  Synthetic oligonucleotide
gcacctggtcaactatgcccagcaa

SEQ ID NO: 728074 - DNA, 25 bp, Artificial sequence
  Synthetic oligonucleotide
acagcgagcaactcgaactgatccc

SEQ ID NO: 728075 - DNA, 25 bp, Artificial sequence
  Synthetic oligonucleotide
accgcgacagcgagcaactcgaact

SEQ ID NO: 728076 - DNA, 25 bp, Artificial sequence
  Synthetic oligonucleotide
gagccggaccgcgacagcgagcaac

SEQ ID NO: 728077 - DNA, 25 bp, Artificial sequence
  Synthetic oligonucleotide
actggtcgagccggaccgcgacagc

SEQ ID NO: 728078 - DNA, 25 bp, Artificial sequence
  Synthetic oligonucleotide
ccagcaactggtcgagccggaccgc

SEQ ID NO: 728079 - DNA, 25 bp, Artificial sequence
  Synthetic oligonucleotide
ctatgcccagcaactggtcgagccg

SEQ ID NO: 728080 - DNA, 25 bp, Artificial sequence
  Synthetic oligonucleotide
agctgtcgcgcctggcgctgccgcc

SEQ ID NO: 728081 - DNA, 25 bp, Artificial sequence
  Synthetic oligonucleotide
tgatcccgcgcaagccgagcaagat

SEQ ID NO: 728082 - DNA, 25 bp, Artificial sequence
  Synthetic oligonucleotide
ccggcaagcacagcggtccgagccg

SEQ ID NO: 728083 - DNA, 25 bp, Artificial sequence
  Synthetic oligonucleotide
tggcgctgccgccggtggatttcga

SEQ ID NO: 728084 - DNA, 25 bp, Artificial sequence
  Synthetic oligonucleotide
caacctgggctacgtcaccacctcc

SEQ ID NO: 728085 - DNA, 25 bp, Artificial sequence
  Synthetic oligonucleotide
gaacagcaacctgggctacgtcacc

SEQ ID NO: 728086 - DNA, 25 bp, Artificial sequence
  Synthetic oligonucleotide
tggctgaacagcaacctgggctacg

SEQ ID NO: 728087 - DNA, 25 bp, Artificial sequence
  Synthetic oligonucleotide
cgcgactggctgaacagcaacctgg

SEQ ID NO: 728088 - DNA, 25 bp, Artificial sequence
  Synthetic oligonucleotide
ccgagccgcgactggctgaacagca

SEQ ID NO: 728089 - DNA, 25 bp, Artificial sequence
  Synthetic oligonucleotide
cgtcaccacctcccgggcgcgggcg

SEQ ID NO: 728090 - DNA, 25 bp, Artificial sequence
  Synthetic oligonucleotide
aagcacagcggtccgagccgcgact

SEQ ID NO: 728091 - DNA, 25 bp, Artificial sequence
  Synthetic oligonucleotide
cacctcccgggcgcgggcgaagatc

SEQ ID NO: 728092 - DNA, 25 bp, Artificial sequence
  Synthetic oligonucleotide
tcataaccggcaagcacagcggtcc

SEQ ID NO: 728093 - DNA, 25 bp, Artificial sequence
  Synthetic oligonucleotide
tcgagatcataaccggcaagcacag

SEQ ID NO: 728094 - DNA, 25 bp, Artificial sequence
  Synthetic oligonucleotide
agcaggtcgagatcataaccggcaa

SEQ ID NO: 728095 - DNA, 25 bp, Artificial sequence
  Synthetic oligonucleotide
ccggcgagcaggtcgagatcataac

SEQ ID NO: 728096 - DNA, 25 bp, Artificial sequence
  Synthetic oligonucleotide
tgcagaccggcgagcaggtcgagat

SEQ ID NO: 728097 - DNA, 25 bp, Artificial sequence
  Synthetic oligonucleotide
acagcctgcagaccggcgagcaggt

SEQ ID NO: 728098 - DNA, 25 bp, Artificial sequence
  Synthetic oligonucleotide
tggcggcacattcccaaggagttcg

SEQ ID NO: 728099 - DNA, 25 bp, Artificial sequence
  Synthetic oligonucleotide
agcggtccgagccgcgactggctga

SEQ ID NO: 728100 - DNA, 25 bp, Artificial sequence
  Synthetic oligonucleotide
gcgggaccagaacgtcgctgccggc

SEQ ID NO: 728101 - DNA, 25 bp, Artificial sequence
  Synthetic oligonucleotide
tgccgctgaactacagcctgcagac

SEQ ID NO: 728102 - DNA, 25 bp, Artificial sequence
  Synthetic oligonucleotide
aacgcgagctgtcgcgcctggcgct

SEQ ID NO: 728103 - DNA, 25 bp, Artificial sequence
  Synthetic oligonucleotide
gatcgaacgcgagctgtcgcgcctg

SEQ ID NO: 728104 - DNA, 25 bp, Artificial sequence
  Synthetic oligonucleotide
gccctgatcgaacgcgagctgtcgc

SEQ ID NO: 728105 - DNA, 25 bp, Artificial sequence
  Synthetic oligonucleotide
gcaaggccctgatcgaacgcgagct

SEQ ID NO: 728106 - DNA, 25 bp, Artificial sequence
  Synthetic oligonucleotide
ctgccggcaaggccctgatcgaacg

SEQ ID NO: 728107 - DNA, 25 bp, Artificial sequence
  Synthetic oligonucleotide
tgggctacgtcaccacctcccgggc

SEQ ID NO: 728108 - DNA, 25 bp, Artificial sequence
  Synthetic oligonucleotide
accagaacgtcgctgccggcaaggc

SEQ ID NO: 728109 - DNA, 25 bp, Artificial sequence
  Synthetic oligonucleotide
cgcgcctggcgctgccgccggtgga

SEQ ID NO: 728110 - DNA, 25 bp, Artificial sequence
  Synthetic oligonucleotide
gcaggcgcgggaccagaacgtcgct

SEQ ID NO: 728111 - DNA, 25 bp, Artificial sequence
  Synthetic oligonucleotide
caagctgcaggcgcgggaccagaac

SEQ ID NO: 728112 - DNA, 25 bp, Artificial sequence
  Synthetic oligonucleotide
tggttcaagctgcaggcgcgggacc

SEQ ID NO: 728113 - DNA, 25 bp, Artificial sequence
  Synthetic oligonucleotide
gtccactggttcaagctgcaggcgc

SEQ ID NO: 728114 - DNA, 25 bp, Artificial sequence
  Synthetic oligonucleotide
aagatcgtccactggttcaagctgc

SEQ ID NO: 728115 - DNA, 25 bp, Artificial sequence
  Synthetic oligonucleotide
cgggcgaagatcgtccactggttca

SEQ ID NO: 728116 - DNA, 25 bp, Artificial sequence
  Synthetic oligonucleotide
cgggcgcgggcgaagatcgtccact

SEQ ID NO: 728117 - DNA, 25 bp, Artificial sequence
  Synthetic oligonucleotide
acgtcgctgccggcaaggccctgat

SEQ ID NO: 728118 - DNA, 25 bp, Artificial sequence
  Synthetic oligonucleotide
gccaagctgatcgagggcgtgctgc

SEQ ID NO: 728119 - DNA, 25 bp, Artificial sequence
  Synthetic oligonucleotide
tcaatccgcgccattccatggtgct

SEQ ID NO: 728120 - DNA, 25 bp, Artificial sequence
  Synthetic oligonucleotide
gccagcctcaatccgcgccattcca

SEQ ID NO: 728121 - DNA, 25 bp, Artificial sequence
  Synthetic oligonucleotide
atcagcgccagcctcaatccgcgcc

SEQ ID NO: 728122 - DNA, 25 bp, Artificial sequence
  Synthetic oligonucleotide
gccgcgatcagcgccagcctcaatc

SEQ ID NO: 728123 - DNA, 25 bp, Artificial sequence
  Synthetic oligonucleotide
cgcatggccgcgatcagcgccagcc

SEQ ID NO: 728124 - DNA, 25 bp, Artificial sequence
  Synthetic oligonucleotide
gtgctgcgcatggccgcgatcagcg

SEQ ID NO: 728125 - DNA, 25 bp, Artificial sequence
  Synthetic oligonucleotide
atcaccctggaagcggtcaacaagc

SEQ ID NO: 728126 - DNA, 25 bp, Artificial sequence
  Synthetic oligonucleotide
ctgatcgagggcgtgctgcgcatgg

SEQ ID NO: 728127 - DNA, 25 bp, Artificial sequence
  Synthetic oligonucleotide
tggtgctgggtacccaggcgcaggt

SEQ ID NO: 728128 - DNA, 25 bp, Artificial sequence
  Synthetic oligonucleotide
gtggtggccaagctgatcgagggcg

SEQ ID NO: 728129 - DNA, 25 bp, Artificial sequence
  Synthetic oligonucleotide
cgggccggtggtggccaagctgatc

SEQ ID NO: 728130 - DNA, 25 bp, Artificial sequence
  Synthetic oligonucleotide
catttcgggccggtggtggccaagc

SEQ ID NO: 728131 - DNA, 25 bp, Artificial sequence
  Synthetic oligonucleotide
aacaagcatttcgggccggtggtgg

SEQ ID NO: 728132 - DNA, 25 bp, Artificial sequence
  Synthetic oligonucleotide
cggtcaacaagcatttcgggccggt

SEQ ID NO: 728133 - DNA, 25 bp, Artificial sequence
  Synthetic oligonucleotide
cccaaggagttcgacgactacatcg

SEQ ID NO: 728134 - DNA, 25 bp, Artificial sequence
  Synthetic oligonucleotide
gagggcgtgctgcgcatggccgcga

SEQ ID NO: 728135 - DNA, 25 bp, Artificial sequence
  Synthetic oligonucleotide
tgctggtggcgatggtcgacgacgt

SEQ ID NO: 728136 - DNA, 25 bp, Artificial sequence
  Synthetic oligonucleotide
cgagcgcacctgcgccattcgcgcg

SEQ ID NO: 728137 - DNA, 25 bp, Artificial sequence
  Synthetic oligonucleotide
gctggccgagcgcacctgcgccatt

SEQ ID NO: 728138 - DNA, 25 bp, Artificial sequence
  Synthetic oligonucleotide
tgatcaagctggccgagcgcacctg

SEQ ID NO: 728139 - DNA, 25 bp, Artificial sequence
  Synthetic oligonucleotide
tcgccctgatcaagctggccgagcg

SEQ ID NO: 728140 - DNA, 25 bp, Artificial sequence
  Synthetic oligonucleotide
ttcgcgtcgccctgatcaagctggc

SEQ ID NO: 728141 - DNA, 25 bp, Artificial sequence
  Synthetic oligonucleotide
acgacgttcgcgtcgccctgatcaa

SEQ ID NO: 728142 - DNA, 25 bp, Artificial sequence
  Synthetic oligonucleotide
cgcgccattccatggtgctgggtac

SEQ ID NO: 728143 - DNA, 25 bp, Artificial sequence
  Synthetic oligonucleotide
tggcgatggtcgacgacgttcgcgt

SEQ ID NO: 728144 - DNA, 25 bp, Artificial sequence
  Synthetic oligonucleotide
attccatggtgctgggtacccaggc

SEQ ID NO: 728145 - DNA, 25 bp, Artificial sequence
  Synthetic oligonucleotide
gcaagatgctggtggcgatggtcga

SEQ ID NO: 728146 - DNA, 25 bp, Artificial sequence
  Synthetic oligonucleotide
acctgcgcaagatgctggtggcgat

SEQ ID NO: 728147 - DNA, 25 bp, Artificial sequence
  Synthetic oligonucleotide
tggagaacctgcgcaagatgctggt

SEQ ID NO: 728148 - DNA, 25 bp, Artificial sequence
  Synthetic oligonucleotide
cgcaggtggagaacctgcgcaagat

SEQ ID NO: 728149 - DNA, 25 bp, Artificial sequence
  Synthetic oligonucleotide
acccaggcgcaggtggagaacctgc

SEQ ID NO: 728150 - DNA, 25 bp, Artificial sequence
  Synthetic oligonucleotide
tgggtacccaggcgcaggtggagaa

SEQ ID NO: 728151 - DNA, 25 bp, Artificial sequence
  Synthetic oligonucleotide
gcaagatcaccctggaagcggtcaa

SEQ ID NO: 728152 - DNA, 25 bp, Artificial sequence
  Synthetic oligonucleotide
tggtcgacgacgttcgcgtcgccct

SEQ ID NO: 728153 - DNA, 25 bp, Artificial sequence
  Synthetic oligonucleotide
ttcgctcgcgaatccgagcagcgag

SEQ ID NO: 728154 - DNA, 25 bp, Artificial sequence
  Synthetic oligonucleotide
ggcggaaggcacgtccagcttccag

SEQ ID NO: 728155 - DNA, 25 bp, Artificial sequence
  Synthetic oligonucleotide
ctcctgggcggaaggcacgtccagc

SEQ ID NO: 728156 - DNA, 25 bp, Artificial sequence
  Synthetic oligonucleotide
acagaactcctgggcggaaggcacg

SEQ ID NO: 728157 - DNA, 25 bp, Artificial sequence
  Synthetic oligonucleotide
cgccgcacagaactcctgggcggaa

SEQ ID NO: 728158 - DNA, 25 bp, Artificial sequence
  Synthetic oligonucleotide
agcgatcgccgcacagaactcctgg

SEQ ID NO: 728159 - DNA, 25 bp, Artificial sequence
  Synthetic oligonucleotide
gcagcgagcgatcgccgcacagaac

SEQ ID NO: 728160 - DNA, 25 bp, Artificial sequence
  Synthetic oligonucleotide
ctggaagcggtcaacaagcatttcg

SEQ ID NO: 728161 - DNA, 25 bp, Artificial sequence
  Synthetic oligonucleotide
tcgcgaatccgagcagcgagcgatc

SEQ ID NO: 728162 - DNA, 25 bp, Artificial sequence
  Synthetic oligonucleotide
cttccagaccggactggaaatcgcc

SEQ ID NO: 728163 - DNA, 25 bp, Artificial sequence
  Synthetic oligonucleotide
tgcgagttcgctcgcgaatccgagc

SEQ ID NO: 728164 - DNA, 25 bp, Artificial sequence
  Synthetic oligonucleotide
gaggcttgcgagttcgctcgcgaat

SEQ ID NO: 728165 - DNA, 25 bp, Artificial sequence
  Synthetic oligonucleotide
ttgctggaggcttgcgagttcgctc

SEQ ID NO: 728166 - DNA, 25 bp, Artificial sequence
  Synthetic oligonucleotide
agggcttgctggaggcttgcgagtt

SEQ ID NO: 728167 - DNA, 25 bp, Artificial sequence
  Synthetic oligonucleotide
tcgtcagggcttgctggaggcttgc

SEQ ID NO: 728168 - DNA, 25 bp, Artificial sequence
  Synthetic oligonucleotide
gctcgatcgtcagggcttgctggag

SEQ ID NO: 728169 - DNA, 25 bp, Artificial sequence
  Synthetic oligonucleotide
atccgagcagcgagcgatcgccgca

SEQ ID NO: 728170 - DNA, 25 bp, Artificial sequence
  Synthetic oligonucleotide
agctggatcaggagtccctggtcgc

SEQ ID NO: 728171 - DNA, 25 bp, Artificial sequence
  Synthetic oligonucleotide
gggaaggcaagatcaccctggaagc

SEQ ID NO: 728172 - DNA, 25 bp, Artificial sequence
  Synthetic oligonucleotide
gcgtgcgggaaggcaagatcaccct

SEQ ID NO: 728173 - DNA, 25 bp, Artificial sequence
  Synthetic oligonucleotide
atcgaggcgtgcgggaaggcaagat

SEQ ID NO: 728174 - DNA, 25 bp, Artificial sequence
  Synthetic oligonucleotide
tcatctatcgaggcgtgcgggaagg

SEQ ID NO: 728175 - DNA, 25 bp, Artificial sequence
  Synthetic oligonucleotide
ccgcggtcatctatcgaggcgtgcg

SEQ ID NO: 728176 - DNA, 25 bp, Artificial sequence
  Synthetic oligonucleotide
tggtcgccgcggtcatctatcgagg

SEQ ID NO: 728177 - DNA, 25 bp, Artificial sequence
  Synthetic oligonucleotide
aggcacgtccagcttccagaccgga

SEQ ID NO: 728178 - DNA, 25 bp, Artificial sequence
  Synthetic oligonucleotide
atcaggagtccctggtcgccgcggt

SEQ ID NO: 728179 - DNA, 25 bp, Artificial sequence
  Synthetic oligonucleotide
gtccagcttccagaccggactggaa

SEQ ID NO: 728180 - DNA, 25 bp, Artificial sequence
  Synthetic oligonucleotide
atctcaagctggatcaggagtccct

SEQ ID NO: 728181 - DNA, 25 bp, Artificial sequence
  Synthetic oligonucleotide
tcgcggatctcaagctggatcagga

SEQ ID NO: 728182 - DNA, 25 bp, Artificial sequence
  Synthetic oligonucleotide
gagatcctcgcggatctcaagctgg

SEQ ID NO: 728183 - DNA, 25 bp, Artificial sequence
  Synthetic oligonucleotide
aatcgccgagatcctcgcggatctc

SEQ ID NO: 728184 - DNA, 25 bp, Artificial sequence
  Synthetic oligonucleotide
actggaaatcgccgagatcctcgcg

SEQ ID NO: 728185 - DNA, 25 bp, Artificial sequence
  Synthetic oligonucleotide
gaccggactggaaatcgccgagatc

SEQ ID NO: 728186 - DNA, 25 bp, Artificial sequence
  Synthetic oligonucleotide
cgcgcggtgaagaacgccgacgagg

SEQ ID NO: 728187 - DNA, 25 bp, Artificial sequence
  Synthetic oligonucleotide
agtccctggtcgccgcggtcatcta

SEQ ID NO: 728188 - DNA, 25 bp, Artificial sequence
  Synthetic oligonucleotide
caggccgatctcagcggacgggcga

SEQ ID NO: 728189 - DNA, 25 bp, Artificial sequence
  Synthetic oligonucleotide
aagatgcagcgcaagggcctggact

SEQ ID NO: 728190 - DNA, 25 bp, Artificial sequence
  Synthetic oligonucleotide
tggcgcaagatgcagcgcaagggcc

SEQ ID NO: 728191 - DNA, 25 bp, Artificial sequence
  Synthetic oligonucleotide
tcgatctggcgcaagatgcagcgca

SEQ ID NO: 728192 - DNA, 25 bp, Artificial sequence
  Synthetic oligonucleotide
atctattcgatctggcgcaagatgc

SEQ ID NO: 728193 - DNA, 25 bp, Artificial sequence
  Synthetic oligonucleotide
aaacacatctattcgatctggcgca

SEQ ID NO: 728194 - DNA, 25 bp, Artificial sequence
  Synthetic oligonucleotide
cgggcgaaacacatctattcgatct

SEQ ID NO: 728195 - DNA, 25 bp, Artificial sequence
  Synthetic oligonucleotide
cacctgcgccattcgcgcggtgaag

SEQ ID NO: 728196 - DNA, 25 bp, Artificial sequence
  Synthetic oligonucleotide
gatctcagcggacgggcgaaacaca

SEQ ID NO: 728197 - DNA, 25 bp, Artificial sequence
  Synthetic oligonucleotide
ctggacttcagccagatctacgacg

SEQ ID NO: 728198 - DNA, 25 bp, Artificial sequence
  Synthetic oligonucleotide
ggcgtacaggccgatctcagcggac

SEQ ID NO: 728199 - DNA, 25 bp, Artificial sequence
  Synthetic oligonucleotide
ggccaccggcgtacaggccgatctc

SEQ ID NO: 728200 - DNA, 25 bp, Artificial sequence
  Synthetic oligonucleotide
tctcgcggccaccggcgtacaggcc

SEQ ID NO: 728201 - DNA, 25 bp, Artificial sequence
  Synthetic oligonucleotide
ggaagctctcgcggccaccggcgta

SEQ ID NO: 728202 - DNA, 25 bp, Artificial sequence
  Synthetic oligonucleotide
gttgaaggaagctctcgcggccacc

SEQ ID NO: 728203 - DNA, 25 bp, Artificial sequence
  Synthetic oligonucleotide
gagccagttgaaggaagctctcgcg

SEQ ID NO: 728204 - DNA, 25 bp, Artificial sequence
  Synthetic oligonucleotide
agcggacgggcgaaacacatctatt

SEQ ID NO: 728205 - DNA, 25 bp, Artificial sequence
  Synthetic oligonucleotide
tcgttccggagatgcgcgactgcta

SEQ ID NO: 728206 - DNA, 25 bp, Artificial sequence
  Synthetic oligonucleotide
accctctggcggcacattcccaagg

SEQ ID NO: 728207 - DNA, 25 bp, Artificial sequence
  Synthetic oligonucleotide
gtgcataccctctggcggcacattc

SEQ ID NO: 728208 - DNA, 25 bp, Artificial sequence
  Synthetic oligonucleotide
ggcatcgtgcataccctctggcggc

SEQ ID NO: 728209 - DNA, 25 bp, Artificial sequence
  Synthetic oligonucleotide
gcgctgggcatcgtgcataccctct

SEQ ID NO: 728210 - DNA, 25 bp, Artificial sequence
  Synthetic oligonucleotide
tacaccgcgctgggcatcgtgcata

SEQ ID NO: 728211 - DNA, 25 bp, Artificial sequence
  Synthetic oligonucleotide
actgctacaccgcgctgggcatcgt

SEQ ID NO: 728212 - DNA, 25 bp, Artificial sequence
  Synthetic oligonucleotide
cagcgcaagggcctggacttcagcc

SEQ ID NO: 728213 - DNA, 25 bp, Artificial sequence
  Synthetic oligonucleotide
ggagatgcgcgactgctacaccgcg

SEQ ID NO: 728214 - DNA, 25 bp, Artificial sequence
  Synthetic oligonucleotide
aagggcctggacttcagccagatct

SEQ ID NO: 728215 - DNA, 25 bp, Artificial sequence
  Synthetic oligonucleotide
gcgtgctcgttccggagatgcgcga

SEQ ID NO: 728216 - DNA, 25 bp, Artificial sequence
  Synthetic oligonucleotide
ccgtgcgcgtgctcgttccggagat

SEQ ID NO: 728217 - DNA, 25 bp, Artificial sequence
  Synthetic oligonucleotide
ttcgcgccgtgcgcgtgctcgttcc

SEQ ID NO: 728218 - DNA, 25 bp, Artificial sequence
  Synthetic oligonucleotide
acgacgttcgcgccgtgcgcgtgct

SEQ ID NO: 728219 - DNA, 25 bp, Artificial sequence
  Synthetic oligonucleotide
agatctacgacgttcgcgccgtgcg

SEQ ID NO: 728220 - DNA, 25 bp, Artificial sequence
  Synthetic oligonucleotide
ttcagccagatctacgacgttcgcg

SEQ ID NO: 728221 - DNA, 25 bp, Artificial sequence
  Synthetic oligonucleotide
gtacatcgccaacgtgatgagccag

SEQ ID NO: 728222 - DNA, 25 bp, Artificial sequence
  Synthetic oligonucleotide
tgcgcgactgctacaccgcgctggg

SEQ ID NO: 728223 - DNA, 25 bp, Artificial sequence
  Synthetic oligonucleotide
cgcccgggaagtcttcgatatctac

SEQ ID NO: 728224 - DNA, 25 bp, Artificial sequence
  Synthetic oligonucleotide
cgtgatgagccagttgaaggaagct

SEQ ID NO: 728225 - DNA, 25 bp, Artificial sequence
  Synthetic oligonucleotide
cgcctgggcatcgggcatatcaagt

SEQ ID NO: 728226 - DNA, 25 bp, Artificial sequence
  Synthetic oligonucleotide
gcccaccgcctgggcatcgggcata

SEQ ID NO: 728227 - DNA, 25 bp, Artificial sequence
  Synthetic oligonucleotide
ccgctggcccaccgcctgggcatcg

SEQ ID NO: 728228 - DNA, 25 bp, Artificial sequence
  Synthetic oligonucleotide
tacgcgccgctggcccaccgcctgg

SEQ ID NO: 728229 - DNA, 25 bp, Artificial sequence
  Synthetic oligonucleotide
atatctacgcgccgctggcccaccg

SEQ ID NO: 728230 - DNA, 25 bp, Artificial sequence
  Synthetic oligonucleotide
gggcatatcaagtgggagctggagg

SEQ ID NO: 728231 - DNA, 25 bp, Artificial sequence
  Synthetic oligonucleotide
ggaagtcttcgatatctacgcgccg

SEQ ID NO: 728232 - DNA, 25 bp, Artificial sequence
  Synthetic oligonucleotide
atcaagtgggagctggaggacctgt

SEQ ID NO: 728233 - DNA, 25 bp, Artificial sequence
  Synthetic oligonucleotide
ccgcgtcgcccgggaagtcttcgat

SEQ ID NO: 728234 - DNA, 25 bp, Artificial sequence
  Synthetic oligonucleotide
agcgccaccgcgtcgcccgggaagt

SEQ ID NO: 728235 - DNA, 25 bp, Artificial sequence
  Synthetic oligonucleotide
aggaaaagcgccaccgcgtcgcccg

SEQ ID NO: 728236 - DNA, 25 bp, Artificial sequence
  Synthetic oligonucleotide
cgacgaggaaaagcgccaccgcgtc

SEQ ID NO: 728237 - DNA, 25 bp, Artificial sequence
  Synthetic oligonucleotide
gaacgccgacgaggaaaagcgccac

SEQ ID NO: 728238 - DNA, 25 bp, Artificial sequence
  Synthetic oligonucleotide
gtgaagaacgccgacgaggaaaagc

SEQ ID NO: 728239 - DNA, 25 bp, Artificial sequence
  Synthetic oligonucleotide
ccagggtgtcggcaacctcctgacg

SEQ ID NO: 728240 - DNA, 25 bp, Artificial sequence
  Synthetic oligonucleotide
tcttcgatatctacgcgccgctggc

SEQ ID NO: 728241 - DNA, 25 bp, Artificial sequence
  Synthetic oligonucleotide
tacaagcagatcgccaagctgctgc

SEQ ID NO: 728242 - DNA, 25 bp, Artificial sequence
  Synthetic oligonucleotide
gccattcgcgcggtgaagaacgccg

SEQ ID NO: 728243 - DNA, 25 bp, Artificial sequence
  Synthetic oligonucleotide
tgagcagtacatcgccaacgtgatg

SEQ ID NO: 728244 - DNA, 25 bp, Artificial sequence
  Synthetic oligonucleotide
ggatcgtgagcagtacatcgccaac

SEQ ID NO: 728245 - DNA, 25 bp, Artificial sequence
  Synthetic oligonucleotide
ccggctggatcgtgagcagtacatc

SEQ ID NO: 728246 - DNA, 25 bp, Artificial sequence
  Synthetic oligonucleotide
cgagcgccggctggatcgtgagcag

SEQ ID NO: 728247 - DNA, 25 bp, Artificial sequence
  Synthetic oligonucleotide
gctgcacgagcgccggctggatcgt

SEQ ID NO: 728248 - DNA, 25 bp, Artificial sequence
  Synthetic oligonucleotide
gcatcgggcatatcaagtgggagct

SEQ ID NO: 728249 - DNA, 25 bp, Artificial sequence
  Synthetic oligonucleotide
cagatcgccaagctgctgcacgagc

SEQ ID NO: 728250 - DNA, 25 bp, Artificial sequence
  Synthetic oligonucleotide
cgccaacgtgatgagccagttgaag

SEQ ID NO: 728251 - DNA, 25 bp, Artificial sequence
  Synthetic oligonucleotide
gaccagtacaagcagatcgccaagc

SEQ ID NO: 728252 - DNA, 25 bp, Artificial sequence
  Synthetic oligonucleotide
gagcccgaccagtacaagcagatcg

SEQ ID NO: 728253 - DNA, 25 bp, Artificial sequence
  Synthetic oligonucleotide
ttacctcgagcccgaccagtacaag

SEQ ID NO: 728254 - DNA, 25 bp, Artificial sequence
  Synthetic oligonucleotide
cttccgttacctcgagcccgaccag

SEQ ID NO: 728255 - DNA, 25 bp, Artificial sequence
  Synthetic oligonucleotide
gacctgtccttccgttacctcgagc

SEQ ID NO: 728256 - DNA, 25 bp, Artificial sequence
  Synthetic oligonucleotide
gctggaggacctgtccttccgttac

SEQ ID NO: 728257 - DNA, 25 bp, Artificial sequence
  Synthetic oligonucleotide
tgggagctggaggacctgtccttcc

SEQ ID NO: 728258 - DNA, 25 bp, Artificial sequence
  Synthetic oligonucleotide
ccaagctgctgcacgagcgccggct

SEQ ID NO: 728259 - DNA, 25 bp, Artificial sequence
  Synthetic oligonucleotide
agagggtgacgagggtgccgtgggc

SEQ ID NO: 728260 - DNA, 25 bp, Artificial sequence
  Synthetic oligonucleotide
gtcgtggtcaacctggcccggcatc

SEQ ID NO: 728261 - DNA, 25 bp, Artificial sequence
  Synthetic oligonucleotide
ctgttcgtcgtggtcaacctggccc

SEQ ID NO: 728262 - DNA, 25 bp, Artificial sequence
  Synthetic oligonucleotide
acctgctgttcgtcgtggtcaacct

SEQ ID NO: 728263 - DNA, 25 bp, Artificial sequence
  Synthetic oligonucleotide
ttggcgacctgctgttcgtcgtggt

SEQ ID NO: 728264 - DNA, 25 bp, Artificial sequence
  Synthetic oligonucleotide
aggaggttggcgacctgctgttcgt

SEQ ID NO: 728265 - DNA, 25 bp, Artificial sequence
  Synthetic oligonucleotide
tgggcgaggaggttggcgacctgct

SEQ ID NO: 728266 - DNA, 25 bp, Artificial sequence
  Synthetic oligonucleotide
acaaggttcgcgaggggctggacga

SEQ ID NO: 728267 - DNA, 25 bp, Artificial sequence
  Synthetic oligonucleotide
tgacgagggtgccgtgggcgaggag

SEQ ID NO: 728268 - DNA, 25 bp, Artificial sequence
  Synthetic oligonucleotide
ggcatctcaaggtcgatccggaggc

SEQ ID NO: 728269 - DNA, 25 bp, Artificial sequence
  Synthetic oligonucleotide
gatggcagagggtgacgagggtgcc

SEQ ID NO: 728270 - DNA, 25 bp, Artificial sequence
  Synthetic oligonucleotide
cgaggcgatggcagagggtgacgag

SEQ ID NO: 728271 - DNA, 25 bp, Artificial sequence
  Synthetic oligonucleotide
agtcctcgaggcgatggcagagggt

SEQ ID NO: 728272 - DNA, 25 bp, Artificial sequence
  Synthetic oligonucleotide
tggacgaagtcctcgaggcgatggc

SEQ ID NO: 728273 - DNA, 25 bp, Artificial sequence
  Synthetic oligonucleotide
aggggctggacgaagtcctcgaggc

SEQ ID NO: 728274 - DNA, 25 bp, Artificial sequence
  Synthetic oligonucleotide
gacgtgcagatccagggtgtcggca

SEQ ID NO: 728275 - DNA, 25 bp, Artificial sequence
  Synthetic oligonucleotide
ggtgccgtgggcgaggaggttggcg

SEQ ID NO: 728276 - DNA, 25 bp, Artificial sequence
  Synthetic oligonucleotide
acggcaagttcgagcggcgattccg

SEQ ID NO: 728277 - DNA, 25 bp, Artificial sequence
  Synthetic oligonucleotide
agccggccggaaagccgaagagtgt

SEQ ID NO: 728278 - DNA, 25 bp, Artificial sequence
  Synthetic oligonucleotide
gcgcgaagccggccggaaagccgaa

SEQ ID NO: 728279 - DNA, 25 bp, Artificial sequence
  Synthetic oligonucleotide
gaacctgcgcgaagccggccggaaa

SEQ ID NO: 728280 - DNA, 25 bp, Artificial sequence
  Synthetic oligonucleotide
tcgagcggaacctgcgcgaagccgg

SEQ ID NO: 728281 - DNA, 25 bp, Artificial sequence
  Synthetic oligonucleotide
gttcatcgagcggaacctgcgcgaa

SEQ ID NO: 728282 - DNA, 25 bp, Artificial sequence
  Synthetic oligonucleotide
gattccggttcatcgagcggaacct

SEQ ID NO: 728283 - DNA, 25 bp, Artificial sequence
  Synthetic oligonucleotide
tcaacctggcccggcatctcaaggt

SEQ ID NO: 728284 - DNA, 25 bp, Artificial sequence
  Synthetic oligonucleotide
agttcgagcggcgattccggttcat

SEQ ID NO: 728285 - DNA, 25 bp, Artificial sequence
  Synthetic oligonucleotide
tggcccggcatctcaaggtcgatcc

SEQ ID NO: 728286 - DNA, 25 bp, Artificial sequence
  Synthetic oligonucleotide
aggccaacggcaagttcgagcggcg

SEQ ID NO: 728287 - DNA, 25 bp, Artificial sequence
  Synthetic oligonucleotide
tgcgccaggccaacggcaagttcga

SEQ ID NO: 728288 - DNA, 25 bp, Artificial sequence
  Synthetic oligonucleotide
ctgctctgcgccaggccaacggcaa

SEQ ID NO: 728289 - DNA, 25 bp, Artificial sequence
  Synthetic oligonucleotide
cggaggctgctctgcgccaggccaa

SEQ ID NO: 728290 - DNA, 25 bp, Artificial sequence
  Synthetic oligonucleotide
tcgatccggaggctgctctgcgcca

SEQ ID NO: 728291 - DNA, 25 bp, Artificial sequence
  Synthetic oligonucleotide
ctcaaggtcgatccggaggctgctc

SEQ ID NO: 728292 - DNA, 25 bp, Artificial sequence
  Synthetic oligonucleotide
tggtggacaaggttcgcgaggggct

SEQ ID NO: 728293 - DNA, 25 bp, Artificial sequence
  Synthetic oligonucleotide
agcggcgattccggttcatcgagcg

SEQ ID NO: 728294 - DNA, 25 bp, Artificial sequence
  Synthetic oligonucleotide
gggaagaactgaaggccgaggagcg

SEQ ID NO: 728295 - DNA, 25 bp, Artificial sequence
  Synthetic oligonucleotide
agcagttgtcgctgctggatgacgt

SEQ ID NO: 728296 - DNA, 25 bp, Artificial sequence
  Synthetic oligonucleotide
agccgcagcagttgtcgctgctgga

SEQ ID NO: 728297 - DNA, 25 bp, Artificial sequence
  Synthetic oligonucleotide
ccaaggagccgcagcagttgtcgct

SEQ ID NO: 728298 - DNA, 25 bp, Artificial sequence
  Synthetic oligonucleotide
ccaaggccaaggagccgcagcagtt

SEQ ID NO: 728299 - DNA, 25 bp, Artificial sequence
  Synthetic oligonucleotide
gtgccgccaaggccaaggagccgca

SEQ ID NO: 728300 - DNA, 25 bp, Artificial sequence
  Synthetic oligonucleotide
aggagcgtgccgccaaggccaagga

SEQ ID NO: 728301 - DNA, 25 bp, Artificial sequence
  Synthetic oligonucleotide
ttcgcgaggggctggacgaagtcct

SEQ ID NO: 728302 - DNA, 25 bp, Artificial sequence
  Synthetic oligonucleotide
aactgaaggccgaggagcgtgccgc

SEQ ID NO: 728303 - DNA, 25 bp, Artificial sequence
  Synthetic oligonucleotide
gatgacgttcctgtcgccctgccgg

SEQ ID NO: 728304 - DNA, 25 bp, Artificial sequence
  Synthetic oligonucleotide
cagcgctgggaagaactgaaggccg

SEQ ID NO: 728305 - DNA, 25 bp, Artificial sequence
  Synthetic oligonucleotide
gtcaagcagcgctgggaagaactga

SEQ ID NO: 728306 - DNA, 25 bp, Artificial sequence
  Synthetic oligonucleotide
gcggcagtcaagcagcgctgggaag

SEQ ID NO: 728307 - DNA, 25 bp, Artificial sequence
  Synthetic oligonucleotide
gccgaagcggcagtcaagcagcgct

SEQ ID NO: 728308 - DNA, 25 bp, Artificial sequence
  Synthetic oligonucleotide
gaagctggccgaagcggcagtcaag

SEQ ID NO: 728309 - DNA, 25 bp, Artificial sequence
  Synthetic oligonucleotide
tgcggcgaagctggccgaagcggca

SEQ ID NO: 728310 - DNA, 25 bp, Artificial sequence
  Synthetic oligonucleotide
aggccgaggagcgtgccgccaaggc

SEQ ID NO: 728311 - DNA, 25 bp, Artificial sequence
  Synthetic oligonucleotide
aagctgcagaagcgcgcggcgcagg

SEQ ID NO: 728312 - DNA, 25 bp, Artificial sequence
  Synthetic oligonucleotide
tgccggtggtggacaaggttcgcga

SEQ ID NO: 728313 - DNA, 25 bp, Artificial sequence
  Synthetic oligonucleotide
aagcgctgccggtggtggacaaggt

SEQ ID NO: 728314 - DNA, 25 bp, Artificial sequence
  Synthetic oligonucleotide
ggccggaagcgctgccggtggtgga

SEQ ID NO: 728315 - DNA, 25 bp, Artificial sequence
  Synthetic oligonucleotide
tcgactggccggaagcgctgccggt

SEQ ID NO: 728316 - DNA, 25 bp, Artificial sequence
  Synthetic oligonucleotide
tcggcttcgactggccggaagcgct

SEQ ID NO: 728317 - DNA, 25 bp, Artificial sequence
  Synthetic oligonucleotide
cgcaggtcggcttcgactggccgga

SEQ ID NO: 728318 - DNA, 25 bp, Artificial sequence
  Synthetic oligonucleotide
tgtcgctgctggatgacgttcctgt

SEQ ID NO: 728319 - DNA, 25 bp, Artificial sequence
  Synthetic oligonucleotide
cagaagcgcgcggcgcaggtcggct

SEQ ID NO: 728320 - DNA, 25 bp, Artificial sequence
  Synthetic oligonucleotide
tgctggatgacgttcctgtcgccct

SEQ ID NO: 728321 - DNA, 25 bp, Artificial sequence
  Synthetic oligonucleotide
gcggcgaagctgcagaagcgcgcgg

SEQ ID NO: 728322 - DNA, 25 bp, Artificial sequence
  Synthetic oligonucleotide
tcacgggcggcgaagctgcagaagc

SEQ ID NO: 728323 - DNA, 25 bp, Artificial sequence
  Synthetic oligonucleotide
gcgttgtcacgggcggcgaagctgc

SEQ ID NO: 728324 - DNA, 25 bp, Artificial sequence
  Synthetic oligonucleotide
ctgccggcgttgtcacgggcggcga

SEQ ID NO: 728325 - DNA, 25 bp, Artificial sequence
  Synthetic oligonucleotide
tgtcgccctgccggcgttgtcacgg

SEQ ID NO: 728326 - DNA, 25 bp, Artificial sequence
  Synthetic oligonucleotide
gttcctgtcgccctgccggcgttgt

SEQ ID NO: 728327 - DNA, 25 bp, Artificial sequence
  Synthetic oligonucleotide
agagtgttcgctggaggaactggac

SEQ ID NO: 728328 - DNA, 25 bp, Artificial sequence
  Synthetic oligonucleotide
gcgcggcgcaggtcggcttcgactg

SEQ ID NO: 728329 - DNA, 25 bp, Artificial sequence
  Synthetic oligonucleotide
tgatgctgccgacgcgttcgccttc

SEQ ID NO: 728330 - DNA, 25 bp, Artificial sequence
  Synthetic oligonucleotide
gcccgagaatgccgctgatccagcg

SEQ ID NO: 728331 - DNA, 25 bp, Artificial sequence
  Synthetic oligonucleotide
gtcgcacgcccgagaatgccgctga

SEQ ID NO: 728332 - DNA, 25 bp, Artificial sequence
  Synthetic oligonucleotide
ggtgcggtcgcacgcccgagaatgc

SEQ ID NO: 728333 - DNA, 25 bp, Artificial sequence
  Synthetic oligonucleotide
tctgcggtgcggtcgcacgcccgag

SEQ ID NO: 728334 - DNA, 25 bp, Artificial sequence
  Synthetic oligonucleotide
cgacgttctgcggtgcggtcgcacg

SEQ ID NO: 728335 - DNA, 25 bp, Artificial sequence
  Synthetic oligonucleotide
cgccttcgacgttctgcggtgcggt

SEQ ID NO: 728336 - DNA, 25 bp, Artificial sequence
  Synthetic oligonucleotide
ccggaaagccgaagagtgttcgctg

SEQ ID NO: 728337 - DNA, 25 bp, Artificial sequence
  Synthetic oligonucleotide
tgccgacgcgttcgccttcgacgtt

SEQ ID NO: 728338 - DNA, 25 bp, Artificial sequence
  Synthetic oligonucleotide
atccagcgattgaggcgggtcagca

SEQ ID NO: 728339 - DNA, 25 bp, Artificial sequence
  Synthetic oligonucleotide
ctggttgatgctgccgacgcgttcg

SEQ ID NO: 728340 - DNA, 25 bp, Artificial sequence
  Synthetic oligonucleotide
taggcctggttgatgctgccgacgc

SEQ ID NO: 728341 - DNA, 25 bp, Artificial sequence
  Synthetic oligonucleotide
accgagtaggcctggttgatgctgc

SEQ ID NO: 728342 - DNA, 25 bp, Artificial sequence
  Synthetic oligonucleotide
atggcgaccgagtaggcctggttga

SEQ ID NO: 728343 - DNA, 25 bp, Artificial sequence
  Synthetic oligonucleotide
ccgcgaatggcgaccgagtaggcct

SEQ ID NO: 728344 - DNA, 25 bp, Artificial sequence
  Synthetic oligonucleotide
attgccgccgcgaatggcgaccgag

SEQ ID NO: 728345 - DNA, 25 bp, Artificial sequence
  Synthetic oligonucleotide
cgcgttcgccttcgacgttctgcgg

SEQ ID NO: 728346 - DNA, 25 bp, Artificial sequence
  Synthetic oligonucleotide
gctcgatatcgcagaagagaatcac

SEQ ID NO: 728347 - DNA, 25 bp, Artificial sequence
  Synthetic oligonucleotide
cagtggacgaaggtttcgtcgaaca

SEQ ID NO: 728348 - DNA, 25 bp, Artificial sequence
  Synthetic oligonucleotide
tcttcacccagtggacgaaggtttc

SEQ ID NO: 728349 - DNA, 25 bp, Artificial sequence
  Synthetic oligonucleotide
gtctcgttcttcacccagtggacga

SEQ ID NO: 728350 - DNA, 25 bp, Artificial sequence
  Synthetic oligonucleotide
tgctcggtctcgttcttcacccagt

SEQ ID NO: 728351 - DNA, 25 bp, Artificial sequence
  Synthetic oligonucleotide
cgggtctgctcggtctcgttcttca

SEQ ID NO: 728352 - DNA, 25 bp, Artificial sequence
  Synthetic oligonucleotide
aatcacccgggtctgctcggtctcg

SEQ ID NO: 728353 - DNA, 25 bp, Artificial sequence
  Synthetic oligonucleotide
gaatgccgctgatccagcgattgag

SEQ ID NO: 728354 - DNA, 25 bp, Artificial sequence
  Synthetic oligonucleotide
tatcgcagaagagaatcacccgggt

SEQ ID NO: 728355 - DNA, 25 bp, Artificial sequence
  Synthetic oligonucleotide
cgctgatccagcgattgaggcgggt

SEQ ID NO: 728356 - DNA, 25 bp, Artificial sequence
  Synthetic oligonucleotide
gcggccgctcgatatcgcagaagag

SEQ ID NO: 728357 - DNA, 25 bp, Artificial sequence
  Synthetic oligonucleotide
agcggagcggccgctcgatatcgca

SEQ ID NO: 728358 - DNA, 25 bp, Artificial sequence
  Synthetic oligonucleotide
aggcgggagcggagcggccgctcga

SEQ ID NO: 728359 - DNA, 25 bp, Artificial sequence
  Synthetic oligonucleotide
gtcagcaggcgggagcggagcggcc

SEQ ID NO: 728360 - DNA, 25 bp, Artificial sequence
  Synthetic oligonucleotide
gaggcgggtcagcaggcgggagcgg

SEQ ID NO: 728361 - DNA, 25 bp, Artificial sequence
  Synthetic oligonucleotide
cgattgaggcgggtcagcaggcggg

SEQ ID NO: 728362 - DNA, 25 bp, Artificial sequence
  Synthetic oligonucleotide
ttcacctgggcgccgatggcattgc

SEQ ID NO: 728363 - DNA, 25 bp, Artificial sequence
  Synthetic oligonucleotide
gaagagaatcacccgggtctgctcg

SEQ ID NO: 728364 - DNA, 25 bp, Artificial sequence
  Synthetic oligonucleotide
aagaaagcggagaggagcgcgcccg

SEQ ID NO: 728365 - DNA, 25 bp, Artificial sequence
  Synthetic oligonucleotide
cgatggcattgccgccgcgaatggc

SEQ ID NO: 728366 - DNA, 25 bp, Artificial sequence
  Synthetic oligonucleotide
cgtggcagccgggctgccacggcat

SEQ ID NO: 728367 - DNA, 25 bp, Artificial sequence
  Synthetic oligonucleotide
aaattaccgtggcagccgggctgcc

SEQ ID NO: 728368 - DNA, 25 bp, Artificial sequence
  Synthetic oligonucleotide
atgggaaaattaccgtggcagccgg

SEQ ID NO: 728369 - DNA, 25 bp, Artificial sequence
  Synthetic oligonucleotide
tgttaatgggaaaattaccgtggca

SEQ ID NO: 728370 - DNA, 25 bp, Artificial sequence
  Synthetic oligonucleotide
cgcgcccggctgttaatgggaaaat

SEQ ID NO: 728371 - DNA, 25 bp, Artificial sequence
  Synthetic oligonucleotide
gctgccacggcatctgaatcagccg

SEQ ID NO: 728372 - DNA, 25 bp, Artificial sequence
  Synthetic oligonucleotide
gcggagaggagcgcgcccggctgtt

SEQ ID NO: 728373 - DNA, 25 bp, Artificial sequence
  Synthetic oligonucleotide
acggcatctgaatcagccgaagatc

SEQ ID NO: 728374 - DNA, 25 bp, Artificial sequence
  Synthetic oligonucleotide
gaggctaagaaagcggagaggagcg

SEQ ID NO: 728375 - DNA, 25 bp, Artificial sequence
  Synthetic oligonucleotide
tggggcgaggctaagaaagcggaga

SEQ ID NO: 728376 - DNA, 25 bp, Artificial sequence
  Synthetic oligonucleotide
agcctctggggcgaggctaagaaag

SEQ ID NO: 728377 - DNA, 25 bp, Artificial sequence
  Synthetic oligonucleotide
actggacagcctctggggcgaggct

SEQ ID NO: 728378 - DNA, 25 bp, Artificial sequence
  Synthetic oligonucleotide
ggaggaactggacagcctctggggc

SEQ ID NO: 728379 - DNA, 25 bp, Artificial sequence
  Synthetic oligonucleotide
ttcgctggaggaactggacagcctc

SEQ ID NO: 728380 - DNA, 25 bp, Artificial sequence
  Synthetic oligonucleotide
tctctatggcaagcccgatgcggcg

SEQ ID NO: 728381 - DNA, 25 bp, Artificial sequence
  Synthetic oligonucleotide
aggagcgcgcccggctgttaatggg

SEQ ID NO: 728382 - DNA, 25 bp, Artificial sequence
  Synthetic oligonucleotide
aggatcaccgccagcaccgggcgga

SEQ ID NO: 728383 - DNA, 25 bp, Artificial sequence
  Synthetic oligonucleotide
agccgaagagtgttcgctggaggaa

SEQ ID NO: 728384 - DNA, 25 bp, Artificial sequence
  Synthetic oligonucleotide
aagcgcttcacctgggcgccgatgg

SEQ ID NO: 728385 - DNA, 25 bp, Artificial sequence
  Synthetic oligonucleotide
cgtttgaagcgcttcacctgggcgc

SEQ ID NO: 728386 - DNA, 25 bp, Artificial sequence
  Synthetic oligonucleotide
taggcgcgtttgaagcgcttcacct

SEQ ID NO: 728387 - DNA, 25 bp, Artificial sequence
  Synthetic oligonucleotide
ttcgggtaggcgcgtttgaagcgct

SEQ ID NO: 728388 - DNA, 25 bp, Artificial sequence
  Synthetic oligonucleotide
taggccttcgggtaggcgcgtttga

SEQ ID NO: 728389 - DNA, 25 bp, Artificial sequence
  Synthetic oligonucleotide
agccgggctgccacggcatctgaat

SEQ ID NO: 728390 - DNA, 25 bp, Artificial sequence
  Synthetic oligonucleotide
accgccagcaccgggcggaggattc

SEQ ID NO: 728391 - DNA, 25 bp, Artificial sequence
  Synthetic oligonucleotide
gggcgccgatggcattgccgccgcg

SEQ ID NO: 728392 - DNA, 25 bp, Artificial sequence
  Synthetic oligonucleotide
ccagcaggatcaccgccagcaccgg

SEQ ID NO: 728393 - DNA, 25 bp, Artificial sequence
  Synthetic oligonucleotide
ggatgaccagcaggatcaccgccag

SEQ ID NO: 728394 - DNA, 25 bp, Artificial sequence
  Synthetic oligonucleotide
atagaggatgaccagcaggatcacc

SEQ ID NO: 728395 - DNA, 25 bp, Artificial sequence
  Synthetic oligonucleotide
ccaacgatagaggatgaccagcagg

SEQ ID NO: 728396 - DNA, 25 bp, Artificial sequence
  Synthetic oligonucleotide
gaagatccaacgatagaggatgacc

SEQ ID NO: 728397 - DNA, 25 bp, Artificial sequence
  Synthetic oligonucleotide
tcagccgaagatccaacgatagagg

SEQ ID NO: 728398 - DNA, 25 bp, Artificial sequence
  Synthetic oligonucleotide
tctgaatcagccgaagatccaacga

SEQ ID NO: 728399 - DNA, 25 bp, Artificial sequence
  Synthetic oligonucleotide
agcaccgggcggaggattcggtagg

SEQ ID NO: 728400 - DNA, 25 bp, Artificial sequence
  Synthetic oligonucleotide
gtgctgctcaacgagcggatcaacg

SEQ ID NO: 728401 - DNA, 25 bp, Artificial sequence
  Synthetic oligonucleotide
aacaaggaagacaacaccgcgacca

SEQ ID NO: 728402 - DNA, 25 bp, Artificial sequence
  Synthetic oligonucleotide
cgttcgaacaaggaagacaacaccg

SEQ ID NO: 728403 - DNA, 25 bp, Artificial sequence
  Synthetic oligonucleotide
tgaatacccgttcgaacaaggaaga

SEQ ID NO: 728404 - DNA, 25 bp, Artificial sequence
  Synthetic oligonucleotide
tggcggtgaatacccgttcgaacaa

SEQ ID NO: 728405 - DNA, 25 bp, Artificial sequence
  Synthetic oligonucleotide
cgttctggcggtgaatacccgttcg

SEQ ID NO: 728406 - DNA, 25 bp, Artificial sequence
  Synthetic oligonucleotide
gatcaacgttctggcggtgaatacc

SEQ ID NO: 728407 - DNA, 25 bp, Artificial sequence
  Synthetic oligonucleotide
gcggcgcaaccgtacgccttgaggc

SEQ ID NO: 728408 - DNA, 25 bp, Artificial sequence
  Synthetic oligonucleotide
ctcaacgagcggatcaacgttctgg

SEQ ID NO: 728409 - DNA, 25 bp, Artificial sequence
  Synthetic oligonucleotide
cgcgaccatgcaactgaccatcgag

SEQ ID NO: 728410 - DNA, 25 bp, Artificial sequence
  Synthetic oligonucleotide
tcccaggtgctgctcaacgagcgga

SEQ ID NO: 728411 - DNA, 25 bp, Artificial sequence
  Synthetic oligonucleotide
gacgtgtcccaggtgctgctcaacg

SEQ ID NO: 728412 - DNA, 25 bp, Artificial sequence
  Synthetic oligonucleotide
gttgcgcgacgtgtcccaggtgctg

SEQ ID NO: 728413 - DNA, 25 bp, Artificial sequence
  Synthetic oligonucleotide
ggcctgttgcgcgacgtgtcccagg

SEQ ID NO: 728414 - DNA, 25 bp, Artificial sequence
  Synthetic oligonucleotide
tcgttccggcctgttgcgcgacgtg

SEQ ID NO: 728415 - DNA, 25 bp, Artificial sequence
  Synthetic oligonucleotide
ctatgatcgttccggcctgttgcgc

SEQ ID NO: 728416 - DNA, 25 bp, Artificial sequence
  Synthetic oligonucleotide
gagcggatcaacgttctggcggtga

SEQ ID NO: 728417 - DNA, 25 bp, Artificial sequence
  Synthetic oligonucleotide
gctcttggacgcctgctggcgcgcg

SEQ ID NO: 728418 - DNA, 25 bp, Artificial sequence
  Synthetic oligonucleotide
gcccgatgcggcgaagctggccgaa

SEQ ID NO: 728419 - DNA, 25 bp, Artificial sequence
  Synthetic oligonucleotide
acatcatcgaggcgcggcgcaaccg

SEQ ID NO: 728420 - DNA, 25 bp, Artificial sequence
  Synthetic oligonucleotide
tgcccaacatcatcgaggcgcggcg

SEQ ID NO: 728421 - DNA, 25 bp, Artificial sequence
  Synthetic oligonucleotide
gcaactgcccaacatcatcgaggcg

SEQ ID NO: 728422 - DNA, 25 bp, Artificial sequence
  Synthetic oligonucleotide
gtctcgcaactgcccaacatcatcg

SEQ ID NO: 728423 - DNA, 25 bp, Artificial sequence
  Synthetic oligonucleotide
gcgcgcgtctcgcaactgcccaaca

SEQ ID NO: 728424 - DNA, 25 bp, Artificial sequence
  Synthetic oligonucleotide
ggaagacaacaccgcgaccatgcaa

SEQ ID NO: 728425 - DNA, 25 bp, Artificial sequence
  Synthetic oligonucleotide
tggacgcctgctggcgcgcgtctcg

SEQ ID NO: 728426 - DNA, 25 bp, Artificial sequence
  Synthetic oligonucleotide
caacaccgcgaccatgcaactgacc

SEQ ID NO: 728427 - DNA, 25 bp, Artificial sequence
  Synthetic oligonucleotide
tggacgctcttggacgcctgctggc

SEQ ID NO: 728428 - DNA, 25 bp, Artificial sequence
  Synthetic oligonucleotide
cggtctggacgctcttggacgcctg

SEQ ID NO: 728429 - DNA, 25 bp, Artificial sequence
  Synthetic oligonucleotide
gattcccggtctggacgctcttgga

SEQ ID NO: 728430 - DNA, 25 bp, Artificial sequence
  Synthetic oligonucleotide
catcgagattcccggtctggacgct

SEQ ID NO: 728431 - DNA, 25 bp, Artificial sequence
  Synthetic oligonucleotide
actgaccatcgagattcccggtctg

SEQ ID NO: 728432 - DNA, 25 bp, Artificial sequence
  Synthetic oligonucleotide
catgcaactgaccatcgagattccc

SEQ ID NO: 728433 - DNA, 25 bp, Artificial sequence
  Synthetic oligonucleotide
ggatatcgcgatccgtgcctatgat

SEQ ID NO: 728434 - DNA, 25 bp, Artificial sequence
  Synthetic oligonucleotide
ctgctggcgcgcgtctcgcaactgc

SEQ ID NO: 728435 - DNA, 25 bp, Artificial sequence
  Synthetic oligonucleotide
gccagccgctgccgggagatcccat

SEQ ID NO: 728436 - DNA, 25 bp, Artificial sequence
  Synthetic oligonucleotide
ccgtgcctatgatcgttccggcctg

SEQ ID NO: 728437 - DNA, 25 bp, Artificial sequence
  Synthetic oligonucleotide
ggccgtggggtcaccatccaccgcc

SEQ ID NO: 728438 - DNA, 25 bp, Artificial sequence
  Synthetic oligonucleotide
cacgctgggccgtggggtcaccatc

SEQ ID NO: 728439 - DNA, 25 bp, Artificial sequence
  Synthetic oligonucleotide
ctacatcacgctgggccgtggggtc

SEQ ID NO: 728440 - DNA, 25 bp, Artificial sequence
  Synthetic oligonucleotide
cgtcggctacatcacgctgggccgt

SEQ ID NO: 728441 - DNA, 25 bp, Artificial sequence
  Synthetic oligonucleotide
tcccatcgtcggctacatcacgctg

SEQ ID NO: 728442 - DNA, 25 bp, Artificial sequence
  Synthetic oligonucleotide
ccatccaccgccaggattgcgccac

SEQ ID NO: 728443 - DNA, 25 bp, Artificial sequence
  Synthetic oligonucleotide
cgctgccgggagatcccatcgtcgg

SEQ ID NO: 728444 - DNA, 25 bp, Artificial sequence
  Synthetic oligonucleotide
accgccaggattgcgccaccgcgct

SEQ ID NO: 728445 - DNA, 25 bp, Artificial sequence
  Synthetic oligonucleotide
gctgctgccagccgctgccgggaga

SEQ ID NO: 728446 - DNA, 25 bp, Artificial sequence
  Synthetic oligonucleotide
tggccggctgctgccagccgctgcc

SEQ ID NO: 728447 - DNA, 25 bp, Artificial sequence
  Synthetic oligonucleotide
gcagatggccggctgctgccagccg

SEQ ID NO: 728448 - DNA, 25 bp, Artificial sequence
  Synthetic oligonucleotide
cctgacgcagatggccggctgctgc

SEQ ID NO: 728449 - DNA, 25 bp, Artificial sequence
  Synthetic oligonucleotide
aacctcctgacgcagatggccggct

SEQ ID NO: 728450 - DNA, 25 bp, Artificial sequence
  Synthetic oligonucleotide
tgtcggcaacctcctgacgcagatg

SEQ ID NO: 728451 - DNA, 25 bp, Artificial sequence
  Synthetic oligonucleotide
acgaaggtttcgtcgaacatcacgt

SEQ ID NO: 728452 - DNA, 25 bp, Artificial sequence
  Synthetic oligonucleotide
cgggagatcccatcgtcggctacat

SEQ ID NO: 728453 - DNA, 25 bp, Artificial sequence
  Synthetic oligonucleotide
gatgatccaggtcagctgggggccg

SEQ ID NO: 728454 - DNA, 25 bp, Artificial sequence
  Synthetic oligonucleotide
caaccgtacgccttgaggcgaggcg

SEQ ID NO: 728455 - DNA, 25 bp, Artificial sequence
  Synthetic oligonucleotide
tccggtggatatcgcgatccgtgcc

SEQ ID NO: 728456 - DNA, 25 bp, Artificial sequence
  Synthetic oligonucleotide
acctatccggtggatatcgcgatcc

SEQ ID NO: 728457 - DNA, 25 bp, Artificial sequence
  Synthetic oligonucleotide
gttcgcacctatccggtggatatcg

SEQ ID NO: 728458 - DNA, 25 bp, Artificial sequence
  Synthetic oligonucleotide
gagccggttcgcacctatccggtgg

SEQ ID NO: 728459 - DNA, 25 bp, Artificial sequence
  Synthetic oligonucleotide
gggccggagccggttcgcacctatc

SEQ ID NO: 728460 - DNA, 25 bp, Artificial sequence
  Synthetic oligonucleotide
gggtcaccatccaccgccaggattg

SEQ ID NO: 728461 - DNA, 25 bp, Artificial sequence
  Synthetic oligonucleotide
tccaggtcagctgggggccggagcc

SEQ ID NO: 728462 - DNA, 25 bp, Artificial sequence
  Synthetic oligonucleotide
cgcgatccgtgcctatgatcgttcc

SEQ ID NO: 728463 - DNA, 25 bp, Artificial sequence
  Synthetic oligonucleotide
ggagcggatgatccaggtcagctgg

SEQ ID NO: 728464 - DNA, 25 bp, Artificial sequence
  Synthetic oligonucleotide
cgaaccggagcggatgatccaggtc

SEQ ID NO: 728465 - DNA, 25 bp, Artificial sequence
  Synthetic oligonucleotide
cgggacgcgaaccggagcggatgat

SEQ ID NO: 728466 - DNA, 25 bp, Artificial sequence
  Synthetic oligonucleotide
caactggcgggacgcgaaccggagc

SEQ ID NO: 728467 - DNA, 25 bp, Artificial sequence
  Synthetic oligonucleotide
gcgctgcaactggcgggacgcgaac

SEQ ID NO: 728468 - DNA, 25 bp, Artificial sequence
  Synthetic oligonucleotide
cgccaccgcgctgcaactggcggga

SEQ ID NO: 728469 - DNA, 25 bp, Artificial sequence
  Synthetic oligonucleotide
aggattgcgccaccgcgctgcaact

SEQ ID NO: 728470 - DNA, 25 bp, Artificial sequence
  Synthetic oligonucleotide
tcagctgggggccggagccggttcg

SEQ ID NO: 728471 - DNA, 25 bp, Artificial sequence
  Synthetic oligonucleotide
cgcaattgcgcgaggaactgggcga

SEQ ID NO: 728472 - DNA, 25 bp, Artificial sequence
  Synthetic oligonucleotide
cagccagttggctcgcgaagaggat

SEQ ID NO: 728473 - DNA, 25 bp, Artificial sequence
  Synthetic oligonucleotide
tctattacagccagttggctcgcga

SEQ ID NO: 728474 - DNA, 25 bp, Artificial sequence
  Synthetic oligonucleotide
aggtggtctattacagccagttggc

SEQ ID NO: 728475 - DNA, 25 bp, Artificial sequence
  Synthetic oligonucleotide
tgttccaggtggtctattacagcca

SEQ ID NO: 728476 - DNA, 25 bp, Artificial sequence
  Synthetic oligonucleotide
acctgctgttccaggtggtctatta

SEQ ID NO: 728477 - DNA, 25 bp, Artificial sequence
  Synthetic oligonucleotide
tgggcgacctgctgttccaggtggt

SEQ ID NO: 728478 - DNA, 25 bp, Artificial sequence
  Synthetic oligonucleotide
tcgaggcgcggcgcaaccgtacgcc

SEQ ID NO: 728479 - DNA, 25 bp, Artificial sequence
  Synthetic oligonucleotide
tgcgcgaggaactgggcgacctgct

SEQ ID NO: 728480 - DNA, 25 bp, Artificial sequence
  Synthetic oligonucleotide
agaggatcgcttcgctttcgacgag

SEQ ID NO: 728481 - DNA, 25 bp, Artificial sequence
  Synthetic oligonucleotide
atttcccgcaattgcgcgaggaact

SEQ ID NO: 728482 - DNA, 25 bp, Artificial sequence
  Synthetic oligonucleotide
agggggatttcccgcaattgcgcga

SEQ ID NO: 728483 - DNA, 25 bp, Artificial sequence
  Synthetic oligonucleotide
tagagcagggggatttcccgcaatt

SEQ ID NO: 728484 - DNA, 25 bp, Artificial sequence
  Synthetic oligonucleotide
acgccatagagcagggggatttccc

SEQ ID NO: 728485 - DNA, 25 bp, Artificial sequence
  Synthetic oligonucleotide
tagcggacgccatagagcaggggga

SEQ ID NO: 728486 - DNA, 25 bp, Artificial sequence
  Synthetic oligonucleotide
acgaagtagcggacgccatagagca

SEQ ID NO: 728487 - DNA, 25 bp, Artificial sequence
  Synthetic oligonucleotide
aggaactgggcgacctgctgttcca

SEQ ID NO: 728488 - DNA, 25 bp, Artificial sequence
  Synthetic oligonucleotide
cccgcaagctgatccgtcgacatcc

SEQ ID NO: 728489 - DNA, 25 bp, Artificial sequence
  Synthetic oligonucleotide
gcagatccagggtgtcggcaacctc

SEQ ID NO: 728490 - DNA, 25 bp, Artificial sequence
  Synthetic oligonucleotide
ggcgatctctatggcaagcccgatg

SEQ ID NO: 728491 - DNA, 25 bp, Artificial sequence
  Synthetic oligonucleotide
tcgatggcgatctctatggcaagcc

SEQ ID NO: 728492 - DNA, 25 bp, Artificial sequence
  Synthetic oligonucleotide
tattcctcgatggcgatctctatgg

SEQ ID NO: 728493 - DNA, 25 bp, Artificial sequence
  Synthetic oligonucleotide
cccacgtattcctcgatggcgatct

SEQ ID NO: 728494 - DNA, 25 bp, Artificial sequence
  Synthetic oligonucleotide
gacatccccacgtattcctcgatgg

SEQ ID NO: 728495 - DNA, 25 bp, Artificial sequence
  Synthetic oligonucleotide
gttggctcgcgaagaggatcgcttc

SEQ ID NO: 728496 - DNA, 25 bp, Artificial sequence
  Synthetic oligonucleotide
agctgatccgtcgacatccccacgt

SEQ ID NO: 728497 - DNA, 25 bp, Artificial sequence
  Synthetic oligonucleotide
tcgcgaagaggatcgcttcgctttc

SEQ ID NO: 728498 - DNA, 25 bp, Artificial sequence
  Synthetic oligonucleotide
gcatcacccgcaagctgatccgtcg

SEQ ID NO: 728499 - DNA, 25 bp, Artificial sequence
  Synthetic oligonucleotide
tggacggcatcacccgcaagctgat

SEQ ID NO: 728500 - DNA, 25 bp, Artificial sequence
  Synthetic oligonucleotide
aggtggtggacggcatcacccgcaa

SEQ ID NO: 728501 - DNA, 25 bp, Artificial sequence
  Synthetic oligonucleotide
tcgacgaggtggtggacggcatcac

SEQ ID NO: 728502 - DNA, 25 bp, Artificial sequence
  Synthetic oligonucleotide
tcgctttcgacgaggtggtggacgg

SEQ ID NO: 728503 - DNA, 25 bp, Artificial sequence
  Synthetic oligonucleotide
tcgcttcgctttcgacgaggtggtg

SEQ ID NO: 728504 - DNA, 25 bp, Artificial sequence
  Synthetic oligonucleotide
acaccctggaagaagcctacgaagt

SEQ ID NO: 728505 - DNA, 25 bp, Artificial sequence
  Synthetic oligonucleotide
tccgtcgacatccccacgtattcct

SEQ ID NO: 728506 - DNA, 25 bp, Artificial sequence
  Synthetic oligonucleotide
ttcgtttccggaaagggcagaatgc

SEQ ID NO: 728507 - DNA, 25 bp, Artificial sequence
  Synthetic oligonucleotide
aagcctacgaagtagcggacgccat

SEQ ID NO: 728508 - DNA, 25 bp, Artificial sequence
  Synthetic oligonucleotide
acccgagatacccatgtaccgactc

SEQ ID NO: 728509 - DNA, 25 bp, Artificial sequence
  Synthetic oligonucleotide
ctgaagacccgagatacccatgtac

SEQ ID NO: 728510 - DNA, 25 bp, Artificial sequence
  Synthetic oligonucleotide
cgttcactgaagacccgagataccc

SEQ ID NO: 728511 - DNA, 25 bp, Artificial sequence
  Synthetic oligonucleotide
ccggaccgttcactgaagacccgag

SEQ ID NO: 728512 - DNA, 25 bp, Artificial sequence
  Synthetic oligonucleotide
agaatgcccggaccgttcactgaag

SEQ ID NO: 728513 - DNA, 25 bp, Artificial sequence
  Synthetic oligonucleotide
catgtaccgactcgacgacctgctc

SEQ ID NO: 728514 - DNA, 25 bp, Artificial sequence
  Synthetic oligonucleotide
tccggaaagggcagaatgcccggac

SEQ ID NO: 728515 - DNA, 25 bp, Artificial sequence
  Synthetic oligonucleotide
ccgactcgacgacctgctccacctc

SEQ ID NO: 728516 - DNA, 25 bp, Artificial sequence
  Synthetic oligonucleotide
gcaggctgcccgtggccttttcgtt

SEQ ID NO: 728517 - DNA, 25 bp, Artificial sequence
  Synthetic oligonucleotide
ggcgctcgcaggctgcccgtggcct

SEQ ID NO: 728518 - DNA, 25 bp, Artificial sequence
  Synthetic oligonucleotide
ggccacgggcgctcgcaggctgccc

SEQ ID NO: 728519 - DNA, 25 bp, Artificial sequence
  Synthetic oligonucleotide
gaaacaggccacgggcgctcgcagg

SEQ ID NO: 728520 - DNA, 25 bp, Artificial sequence
  Synthetic oligonucleotide
gaggcggaaacaggccacgggcgct

SEQ ID NO: 728521 - DNA, 25 bp, Artificial sequence
  Synthetic oligonucleotide
tgaggcgaggcggaaacaggccacg

SEQ ID NO: 728522 - DNA, 25 bp, Artificial sequence
  Synthetic oligonucleotide
acgccttgaggcgaggcggaaacag

SEQ ID NO: 728523 - DNA, 25 bp, Artificial sequence
  Synthetic oligonucleotide
aagggcagaatgcccggaccgttca

SEQ ID NO: 728524 - DNA, 25 bp, Artificial sequence
  Synthetic oligonucleotide
attcggctgcccctgggatctccag

SEQ ID NO: 728525 - DNA, 25 bp, Artificial sequence
  Synthetic oligonucleotide
atggcaagcccgatgcggcgaagct

SEQ ID NO: 728526 - DNA, 25 bp, Artificial sequence
  Synthetic oligonucleotide
tcccgcacaccctggaagaagccta

SEQ ID NO: 728527 - DNA, 25 bp, Artificial sequence
  Synthetic oligonucleotide
ccatcgtcccgcacaccctggaaga

SEQ ID NO: 728528 - DNA, 25 bp, Artificial sequence
  Synthetic oligonucleotide
acgcgaccatcgtcccgcacaccct

SEQ ID NO: 728529 - DNA, 25 bp, Artificial sequence
  Synthetic oligonucleotide
agagctacgcgaccatcgtcccgca

SEQ ID NO: 728530 - DNA, 25 bp, Artificial sequence
  Synthetic oligonucleotide
tccagcagagctacgcgaccatcgt

SEQ ID NO: 728531 - DNA, 25 bp, Artificial sequence
  Synthetic oligonucleotide
gatacccatgtaccgactcgacgac

SEQ ID NO: 728532 - DNA, 25 bp, Artificial sequence
  Synthetic oligonucleotide
tgcccctgggatctccagcagagct

SEQ ID NO: 728533 - DNA, 25 bp, Artificial sequence
  Synthetic oligonucleotide
tggaagaagcctacgaagtagcgga

SEQ ID NO: 728534 - DNA, 25 bp, Artificial sequence
  Synthetic oligonucleotide
tcccgaattcggctgcccctgggat

SEQ ID NO: 728535 - DNA, 25 bp, Artificial sequence
  Synthetic oligonucleotide
gcgcgatcccgaattcggctgcccc

SEQ ID NO: 728536 - DNA, 25 bp, Artificial sequence
  Synthetic oligonucleotide
gcgcctgcgcgatcccgaattcggc

SEQ ID NO: 728537 - DNA, 25 bp, Artificial sequence
  Synthetic oligonucleotide
catggcgcgcctgcgcgatcccgaa

SEQ ID NO: 728538 - DNA, 25 bp, Artificial sequence
  Synthetic oligonucleotide
ccacctcatggcgcgcctgcgcgat

SEQ ID NO: 728539 - DNA, 25 bp, Artificial sequence
  Synthetic oligonucleotide
cctgctccacctcatggcgcgcctg

SEQ ID NO: 728540 - DNA, 25 bp, Artificial sequence
  Synthetic oligonucleotide
cgacgacctgctccacctcatggcg

SEQ ID NO: 728541 - DNA, 25 bp, Artificial sequence
  Synthetic oligonucleotide
tgggatctccagcagagctacgcga

SEQ ID NO: 728542 - DNA, 25 bp, Artificial sequence
  Synthetic oligonucleotide
gccgggcaccgttgtgacagacgat

SEQ ID NO: 728543 - DNA, 25 bp, Artificial sequence
  Synthetic oligonucleotide
atatatcctgtacaataacctgtct

SEQ ID NO: 728544 - DNA, 25 bp, Artificial sequence
  Synthetic oligonucleotide
ggtcatcgctgaattaacagagcac

SEQ ID NO: 728545 - DNA, 25 bp, Artificial sequence
  Synthetic oligonucleotide
gccgggcaccgtagtgacagacgat

SEQ ID NO: 728546 - DNA, 25 bp, Artificial sequence
  Synthetic oligonucleotide
cgggcgaaatgcagatgatatggtc

SEQ ID NO: 728547 - DNA, 25 bp, Artificial sequence
  Synthetic oligonucleotide
cgggcgaaatgctgatgatatggtc

SEQ ID NO: 728548 - DNA, 25 bp, Artificial sequence
  Synthetic oligonucleotide
gattcgcggcgaccatggcatgtcc

SEQ ID NO: 728549 - DNA, 25 bp, Artificial sequence
  Synthetic oligonucleotide
gattcgcggcgagcatggcatgtcc

SEQ ID NO: 728550 - DNA, 25 bp, Artificial sequence
  Synthetic oligonucleotide
cctgatggatttaagatacaaaaaa

SEQ ID NO: 728551 - DNA, 25 bp, Artificial sequence
  Synthetic oligonucleotide
cctgatggattttagatacaaaaaa

SEQ ID NO: 728552 - DNA, 25 bp, Artificial sequence
  Synthetic oligonucleotide
agacgtcgtttttgaagtagatgaa

SEQ ID NO: 728553 - DNA, 25 bp, Artificial sequence
  Synthetic oligonucleotide
agacgtcgttttagaagtagatgaa

SEQ ID NO: 728554 - DNA, 25 bp, Artificial sequence
  Synthetic oligonucleotide
aggcggccctgccggcggtgacgga

SEQ ID NO: 728555 - DNA, 25 bp, Artificial sequence
  Synthetic oligonucleotide
tgtcattgcaagtggcggaagaggc

SEQ ID NO: 728556 - DNA, 25 bp, Artificial sequence
  Synthetic oligonucleotide
ggtcatcgctgatttaacagagcac

SEQ ID NO: 728557 - DNA, 25 bp, Artificial sequence
  Synthetic oligonucleotide
gacatgctatgaatctttctgcctg

SEQ ID NO: 728558 - DNA, 25 bp, Artificial sequence
  Synthetic oligonucleotide
attaaaaatcgtcaaacgggatata

SEQ ID NO: 728559 - DNA, 25 bp, Artificial sequence
  Synthetic oligonucleotide
gtgataagtaggcagcattcgtaga

SEQ ID NO: 728560 - DNA, 25 bp, Artificial sequence
  Synthetic oligonucleotide
gtgataagtagggagcattcgtaga

SEQ ID NO: 728561 - DNA, 25 bp, Artificial sequence
  Synthetic oligonucleotide
tgatgaaatggctaacttctttccg

SEQ ID NO: 728562 - DNA, 25 bp, Artificial sequence
  Synthetic oligonucleotide
tgatgaaatggcaaacttctttccg

SEQ ID NO: 728563 - DNA, 25 bp, Artificial sequence
  Synthetic oligonucleotide
ggatggctgcagttaaatctccgta

SEQ ID NO: 728564 - DNA, 25 bp, Artificial sequence
  Synthetic oligonucleotide
ggatggctgcagataaatctccgta

SEQ ID NO: 728565 - DNA, 25 bp, Artificial sequence
  Synthetic oligonucleotide
ttacgtcttttagtgtaacgccttc

SEQ ID NO: 728566 - DNA, 25 bp, Artificial sequence
  Synthetic oligonucleotide
ttacgtcttttactgtaacgccttc

SEQ ID NO: 728567 - DNA, 25 bp, Artificial sequence
  Synthetic oligonucleotide
gctgcagttcctcttctgtccgttc

SEQ ID NO: 728568 - DNA, 25 bp, Artificial sequence
  Synthetic oligonucleotide
ctgtcagtgtatgcaggtgcacgcc

SEQ ID NO: 728569 - DNA, 25 bp, Artificial sequence
  Synthetic oligonucleotide
gacatgctatgattctttctgcctg

SEQ ID NO: 728570 - DNA, 25 bp, Artificial sequence
  Synthetic oligonucleotide
cttggcaggcttcatcgatgcgatg

SEQ ID NO: 728571 - DNA, 25 bp, Artificial sequence
  Synthetic oligonucleotide
gagcggctgcatgcatgtatacata

SEQ ID NO: 728572 - DNA, 25 bp, Artificial sequence
  Synthetic oligonucleotide
gagcggctgcatccatgtatacata

SEQ ID NO: 728573 - DNA, 25 bp, Artificial sequence
  Synthetic oligonucleotide
tggcgataatcggtacatttttcgc

SEQ ID NO: 728574 - DNA, 25 bp, Artificial sequence
  Synthetic oligonucleotide
aggcggccctgcgggcggtgacgga

SEQ ID NO: 728575 - DNA, 25 bp, Artificial sequence
  Synthetic oligonucleotide
atatatcctgtagaataacctgtct

SEQ ID NO: 728576 - DNA, 25 bp, Artificial sequence
  Synthetic oligonucleotide
aggtgcataagggagagaaaatcgt

SEQ ID NO: 728577 - DNA, 25 bp, Artificial sequence
  Synthetic oligonucleotide
ctttttttgcgacttctcctcctgt

SEQ ID NO: 728578 - DNA, 25 bp, Artificial sequence
  Synthetic oligonucleotide
ctttttttgcgagttctcctcctgt

SEQ ID NO: 728579 - DNA, 25 bp, Artificial sequence
  Synthetic oligonucleotide
tagattccttcacccacagaagaag

SEQ ID NO: 728580 - DNA, 25 bp, Artificial sequence
  Synthetic oligonucleotide
tagattccttcagccacagaagaag

SEQ ID NO: 728581 - DNA, 25 bp, Artificial sequence
  Synthetic oligonucleotide
tgttggcgcccaatagctttaattc

SEQ ID NO: 728582 - DNA, 25 bp, Artificial sequence
  Synthetic oligonucleotide
gctgcagttcctgttctgtccgttc

SEQ ID NO: 728583 - DNA, 25 bp, Artificial sequence
  Synthetic oligonucleotide
aattgagtcacgtccgactaaaacc

SEQ ID NO: 728584 - DNA, 25 bp, Artificial sequence
  Synthetic oligonucleotide
tggcgataatcgctacatttttcgc

SEQ ID NO: 728585 - DNA, 25 bp, Artificial sequence
  Synthetic oligonucleotide
ggacaatcatactagatttgttatc

SEQ ID NO: 728586 - DNA, 25 bp, Artificial sequence
  Synthetic oligonucleotide
ggacaatcatacaagatttgttatc

SEQ ID NO: 728587 - DNA, 25 bp, Artificial sequence
  Synthetic oligonucleotide
tgaaaacatatcatttgaagtgaat

SEQ ID NO: 728588 - DNA, 25 bp, Artificial sequence
  Synthetic oligonucleotide
tgaaaacatatcttttgaagtgaat

SEQ ID NO: 728589 - DNA, 25 bp, Artificial sequence
  Synthetic oligonucleotide
ctctaggcccaaaacgaccttaatg

SEQ ID NO: 728590 - DNA, 25 bp, Artificial sequence
  Synthetic oligonucleotide
ctctaggcccaatacgaccttaatg

SEQ ID NO: 728591 - DNA, 25 bp, Artificial sequence
  Synthetic oligonucleotide
gcaggatgatcagtccggggcgctg

SEQ ID NO: 728592 - DNA, 25 bp, Artificial sequence
  Synthetic oligonucleotide
gcaggatgatcactccggggcgctg

SEQ ID NO: 728593 - DNA, 25 bp, Artificial sequence
  Synthetic oligonucleotide
gtctgcattttcatggagaaattta

SEQ ID NO: 728594 - DNA, 25 bp, Artificial sequence
  Synthetic oligonucleotide
ctgtcagtgtatccaggtgcacgcc

SEQ ID NO: 728595 - DNA, 25 bp, Artificial sequence
  Synthetic oligonucleotide
aattgagtcacgaccgactaaaacc

SEQ ID NO: 728596 - DNA, 25 bp, Artificial sequence
  Synthetic oligonucleotide
tcaaattctcctttcttttgttccc

SEQ ID NO: 728597 - DNA, 25 bp, Artificial sequence
  Synthetic oligonucleotide
tatttctttattattgatattgaga

SEQ ID NO: 728598 - DNA, 25 bp, Artificial sequence
  Synthetic oligonucleotide
tatttctttatttttgatattgaga

SEQ ID NO: 728599 - DNA, 25 bp, Artificial sequence
  Synthetic oligonucleotide
gatgtattgattccaggggccatgc

SEQ ID NO: 728600 - DNA, 25 bp, Artificial sequence
  Synthetic oligonucleotide
gatgtattgattgcaggggccatgc

SEQ ID NO: 728601 - DNA, 25 bp, Artificial sequence
  Synthetic oligonucleotide
gcactcggctgctaagtgaggcttc

SEQ ID NO: 728602 - DNA, 25 bp, Artificial sequence
  Synthetic oligonucleotide
gcactcggctgcaaagtgaggcttc

SEQ ID NO: 728603 - DNA, 25 bp, Artificial sequence
  Synthetic oligonucleotide
cagtcttaccaattataaaaaaagc

SEQ ID NO: 728604 - DNA, 25 bp, Artificial sequence
  Synthetic oligonucleotide
cagtcttaccaaatataaaaaaagc

SEQ ID NO: 728605 - DNA, 25 bp, Artificial sequence
  Synthetic oligonucleotide
ttagtctttaataaaaaatgccggc

SEQ ID NO: 728606 - DNA, 25 bp, Artificial sequence
  Synthetic oligonucleotide
ttagtctttaattaaaaatgccggc

SEQ ID NO: 728607 - DNA, 25 bp, Artificial sequence
  Synthetic oligonucleotide
cttggcaggcttgatcgatgcgatg

SEQ ID NO: 728608 - DNA, 25 bp, Artificial sequence
  Synthetic oligonucleotide
gtctgcattttcttggagaaattta

SEQ ID NO: 728609 - DNA, 25 bp, Artificial sequence
  Synthetic oligonucleotide
acaaggcctgttaccggccggatat

SEQ ID NO: 728610 - DNA, 25 bp, Artificial sequence
  Synthetic oligonucleotide
ggccggatatagaccgcccctactc

SEQ ID NO: 728611 - DNA, 25 bp, Artificial sequence
  Synthetic oligonucleotide
ggccggatatagtccgcccctactc

SEQ ID NO: 728612 - DNA, 25 bp, Artificial sequence
  Synthetic oligonucleotide
tggattttatggctggacattgaga

SEQ ID NO: 728613 - DNA, 25 bp, Artificial sequence
  Synthetic oligonucleotide
tggattttatgggtggacattgaga

SEQ ID NO: 728614 - DNA, 25 bp, Artificial sequence
  Synthetic oligonucleotide
cccagattttttgtattgatcggga

SEQ ID NO: 728615 - DNA, 25 bp, Artificial sequence
  Synthetic oligonucleotide
cccagattttttctattgatcggga

SEQ ID NO: 728616 - DNA, 25 bp, Artificial sequence
  Synthetic oligonucleotide
gtttgaacagcgtcgcaatgaagaa

SEQ ID NO: 728617 - DNA, 25 bp, Artificial sequence
  Synthetic oligonucleotide
gtttgaacagcgacgcaatgaagaa

SEQ ID NO: 728618 - DNA, 25 bp, Artificial sequence
  Synthetic oligonucleotide
ttgtgcaggtatcaagacaggtgtt

SEQ ID NO: 728619 - DNA, 25 bp, Artificial sequence
  Synthetic oligonucleotide
ttgtgcaggtatgaagacaggtgtt

SEQ ID NO: 728620 - DNA, 25 bp, Artificial sequence
  Synthetic oligonucleotide
tgttggcgcccattagctttaattc

SEQ ID NO: 728621 - DNA, 25 bp, Artificial sequence
  Synthetic oligonucleotide
atgatcccggtttcagaatttgcat

SEQ ID NO: 728622 - DNA, 25 bp, Artificial sequence
  Synthetic oligonucleotide
acatttacggtgccggctctgaatc

SEQ ID NO: 728623 - DNA, 25 bp, Artificial sequence
  Synthetic oligonucleotide
acaaggcctgtttccggccggatat

SEQ ID NO: 728624 - DNA, 25 bp, Artificial sequence
  Synthetic oligonucleotide
tttcctcggtaataagcccgtattc

SEQ ID NO: 728625 - DNA, 25 bp, Artificial sequence
  Synthetic oligonucleotide
tttcctcggtaaaaagcccgtattc

SEQ ID NO: 728626 - DNA, 25 bp, Artificial sequence
  Synthetic oligonucleotide
tgactgttacatgatatccctgctg

SEQ ID NO: 728627 - DNA, 25 bp, Artificial sequence
  Synthetic oligonucleotide
tgactgttacatcatatccctgctg

SEQ ID NO: 728628 - DNA, 25 bp, Artificial sequence
  Synthetic oligonucleotide
cagcgcaattatgaatggactgatg

SEQ ID NO: 728629 - DNA, 25 bp, Artificial sequence
  Synthetic oligonucleotide
cagcgcaattatcaatggactgatg

SEQ ID NO: 728630 - DNA, 25 bp, Artificial sequence
  Synthetic oligonucleotide
ataaaatgtcttttcgtttttggca

SEQ ID NO: 728631 - DNA, 25 bp, Artificial sequence
  Synthetic oligonucleotide
ataaaatgtcttatcgtttttggca

SEQ ID NO: 728632 - DNA, 25 bp, Artificial sequence
  Synthetic oligonucleotide
aatgattgaatggccagaaaattgg

SEQ ID NO: 728633 - DNA, 25 bp, Artificial sequence
  Synthetic oligonucleotide
aatgattgaatgcccagaaaattgg

SEQ ID NO: 728634 - DNA, 25 bp, Artificial sequence
  Synthetic oligonucleotide
atgatcccggttacagaatttgcat

SEQ ID NO: 728635 - DNA, 25 bp, Artificial sequence
  Synthetic oligonucleotide
caccctataataagcggaagacatt

SEQ ID NO: 728636 - DNA, 25 bp, Artificial sequence
  Synthetic oligonucleotide
gggtcattgccattgatatggcagc

SEQ ID NO: 728637 - DNA, 25 bp, Artificial sequence
  Synthetic oligonucleotide
aacgtatgtaataactgttccagct

SEQ ID NO: 728638 - DNA, 25 bp, Artificial sequence
  Synthetic oligonucleotide
aacgtatgtaattactgttccagct

SEQ ID NO: 728639 - DNA, 25 bp, Artificial sequence
  Synthetic oligonucleotide
gtatgcctgccataagagatgcgga

SEQ ID NO: 728640 - DNA, 25 bp, Artificial sequence
  Synthetic oligonucleotide
gtatgcctgccaaaagagatgcgga

SEQ ID NO: 728641 - DNA, 25 bp, Artificial sequence
  Synthetic oligonucleotide
gcttcttgttcggtttttcttaatg

SEQ ID NO: 728642 - DNA, 25 bp, Artificial sequence
  Synthetic oligonucleotide
gcttcttgttcgctttttcttaatg

SEQ ID NO: 728643 - DNA, 25 bp, Artificial sequence
  Synthetic oligonucleotide
tcagacggaccgtggtaacctgcag

SEQ ID NO: 728644 - DNA, 25 bp, Artificial sequence
  Synthetic oligonucleotide
tcagacggaccgaggtaacctgcag

SEQ ID NO: 728645 - DNA, 25 bp, Artificial sequence
  Synthetic oligonucleotide
ccggttgaaatggaaatattactcc

SEQ ID NO: 728646 - DNA, 25 bp, Artificial sequence
  Synthetic oligonucleotide
ccggttgaaatgcaaatattactcc

SEQ ID NO: 728647 - DNA, 25 bp, Artificial sequence
  Synthetic oligonucleotide
gtagtcagaggataaacgggtttcc

SEQ ID NO: 728648 - DNA, 25 bp, Artificial sequence
  Synthetic oligonucleotide
aacataacatattgtccttcaaatg

SEQ ID NO: 728649 - DNA, 25 bp, Artificial sequence
  Synthetic oligonucleotide
gtagtcagaggaaaaacgggtttcc

SEQ ID NO: 728650 - DNA, 25 bp, Artificial sequence
  Synthetic oligonucleotide
caccctataatatgcggaagacatt

SEQ ID NO: 728651 - DNA, 25 bp, Artificial sequence
  Synthetic oligonucleotide
gtgtctgctgcaagggttacaggga

SEQ ID NO: 728652 - DNA, 25 bp, Artificial sequence
  Synthetic oligonucleotide
gtgtctgctgcatgggttacaggga

SEQ ID NO: 728653 - DNA, 25 bp, Artificial sequence
  Synthetic oligonucleotide
cggatttggtctagaaagtatgttc

SEQ ID NO: 728654 - DNA, 25 bp, Artificial sequence
  Synthetic oligonucleotide
cggatttggtcttgaaagtatgttc

SEQ ID NO: 728655 - DNA, 25 bp, Artificial sequence
  Synthetic oligonucleotide
ttgcgggatatcagtttttccattt

SEQ ID NO: 728656 - DNA, 25 bp, Artificial sequence
  Synthetic oligonucleotide
ttgcgggatatctgtttttccattt

SEQ ID NO: 728657 - DNA, 25 bp, Artificial sequence
  Synthetic oligonucleotide
aattctgcagcggcagtgaaggcac

SEQ ID NO: 728658 - DNA, 25 bp, Artificial sequence
  Synthetic oligonucleotide
aattctgcagcgccagtgaaggcac

SEQ ID NO: 728659 - DNA, 25 bp, Artificial sequence
  Synthetic oligonucleotide
acatttacggtggcggctctgaatc

SEQ ID NO: 728660 - DNA, 25 bp, Artificial sequence
  Synthetic oligonucleotide
tcaaattctcctatcttttgttccc

SEQ ID NO: 728661 - DNA, 25 bp, Artificial sequence
  Synthetic oligonucleotide
aacataacatatagtccttcaaatg

SEQ ID NO: 728662 - DNA, 25 bp, Artificial sequence
  Synthetic oligonucleotide
agaagtgccattaaacattacacgc

SEQ ID NO: 728663 - DNA, 25 bp, Artificial sequence
  Synthetic oligonucleotide
attaaaaatcgtgaaacgggatata

SEQ ID NO: 728664 - DNA, 25 bp, Artificial sequence
  Synthetic oligonucleotide
taaaatggacatcccggaggctgcg

SEQ ID NO: 728665 - DNA, 25 bp, Artificial sequence
  Synthetic oligonucleotide
agcctttaaagaaaagctgacggat

SEQ ID NO: 728666 - DNA, 25 bp, Artificial sequence
  Synthetic oligonucleotide
agcctttaaagataagctgacggat

SEQ ID NO: 728667 - DNA, 25 bp, Artificial sequence
  Synthetic oligonucleotide
attcccgatcagagcggtgacaaga

SEQ ID NO: 728668 - DNA, 25 bp, Artificial sequence
  Synthetic oligonucleotide
attcccgatcagtgcggtgacaaga

SEQ ID NO: 728669 - DNA, 25 bp, Artificial sequence
  Synthetic oligonucleotide
tgagcttctgttagaggttgccaat

SEQ ID NO: 728670 - DNA, 25 bp, Artificial sequence
  Synthetic oligonucleotide
tgagcttctgtttgaggttgccaat

SEQ ID NO: 728671 - DNA, 25 bp, Artificial sequence
  Synthetic oligonucleotide
cacaccggaattgccgctgtatgac

SEQ ID NO: 728672 - DNA, 25 bp, Artificial sequence
  Synthetic oligonucleotide
cacaccggaattcccgctgtatgac

SEQ ID NO: 728673 - DNA, 25 bp, Artificial sequence
  Synthetic oligonucleotide
gcgtctcactgagcgtccgcaaatt

SEQ ID NO: 728674 - DNA, 25 bp, Artificial sequence
  Synthetic oligonucleotide
tacacaaaaccgtgtcatgtacacg

SEQ ID NO: 728675 - DNA, 25 bp, Artificial sequence
  Synthetic oligonucleotide
gcgtctcactgaccgtccgcaaatt

SEQ ID NO: 728676 - DNA, 25 bp, Artificial sequence
  Synthetic oligonucleotide
agaagtgccatttaacattacacgc

SEQ ID NO: 728677 - DNA, 25 bp, Artificial sequence
  Synthetic oligonucleotide
tgtatttgtgctatcaggagacagc

SEQ ID NO: 728678 - DNA, 25 bp, Artificial sequence
  Synthetic oligonucleotide
tgtatttgtgctttcaggagacagc

SEQ ID NO: 728679 - DNA, 25 bp, Artificial sequence
  Synthetic oligonucleotide
attcaagatgactgatttctcacgt

SEQ ID NO: 728680 - DNA, 25 bp, Artificial sequence
  Synthetic oligonucleotide
attcaagatgacagatttctcacgt

SEQ ID NO: 728681 - DNA, 25 bp, Artificial sequence
  Synthetic oligonucleotide
taaacggtttgcaagacagatgcgc

SEQ ID NO: 728682 - DNA, 25 bp, Artificial sequence
  Synthetic oligonucleotide
taaacggtttgctagacagatgcgc

SEQ ID NO: 728683 - DNA, 25 bp, Artificial sequence
  Synthetic oligonucleotide
tgatgaagcactgagagaacgcgga

SEQ ID NO: 728684 - DNA, 25 bp, Artificial sequence
  Synthetic oligonucleotide
tgatgaagcactcagagaacgcgga

SEQ ID NO: 728685 - DNA, 25 bp, Artificial sequence
  Synthetic oligonucleotide
agatataatcagccttctggaattt

SEQ ID NO: 728686 - DNA, 25 bp, Artificial sequence
  Synthetic oligonucleotide
agatataatcaggcttctggaattt

SEQ ID NO: 728687 - DNA, 25 bp, Artificial sequence
  Synthetic oligonucleotide
tacacaaaaccgagtcatgtacacg

SEQ ID NO: 728688 - DNA, 25 bp, Artificial sequence
  Synthetic oligonucleotide
catggttgaaaccgatgacggacgc

SEQ ID NO: 728689 - DNA, 25 bp, Artificial sequence
  Synthetic oligonucleotide
tagccgctttgctacaccggctaat

SEQ ID NO: 728690 - DNA, 25 bp, Artificial sequence
  Synthetic oligonucleotide
tagccgctttgcaacaccggctaat

SEQ ID NO: 728691 - DNA, 25 bp, Artificial sequence
  Synthetic oligonucleotide
gctttcagaaaagggcgagccggga

SEQ ID NO: 728692 - DNA, 25 bp, Artificial sequence
  Synthetic oligonucleotide
gctttcagaaaacggcgagccggga

SEQ ID NO: 728693 - DNA, 25 bp, Artificial sequence
  Synthetic oligonucleotide
cattgttcttgatttaaaagtgctt

SEQ ID NO: 728694 - DNA, 25 bp, Artificial sequence
  Synthetic oligonucleotide
cattgttcttgaattaaaagtgctt

SEQ ID NO: 728695 - DNA, 25 bp, Artificial sequence
  Synthetic oligonucleotide
acttgtcgggttgccgagtgtggga

SEQ ID NO: 728696 - DNA, 25 bp, Artificial sequence
  Synthetic oligonucleotide
acttgtcgggttcccgagtgtggga

SEQ ID NO: 728697 - DNA, 25 bp, Artificial sequence
  Synthetic oligonucleotide
gctgtctgttgtgtcatctgcaaaa

SEQ ID NO: 728698 - DNA, 25 bp, Artificial sequence
  Synthetic oligonucleotide
gctgtctgttgtctcatctgcaaaa

SEQ ID NO: 728699 - DNA, 25 bp, Artificial sequence
  Synthetic oligonucleotide
taaaatggacatgccggaggctgcg

SEQ ID NO: 728700 - DNA, 25 bp, Artificial sequence
  Synthetic oligonucleotide
ggactatcactttacaacgcttgtc

SEQ ID NO: 728701 - DNA, 25 bp, Artificial sequence
  Synthetic oligonucleotide
gtgccaggctctctattttaaaggg

SEQ ID NO: 728702 - DNA, 25 bp, Artificial sequence
  Synthetic oligonucleotide
catggttgaaacggatgacggacgc

SEQ ID NO: 728703 - DNA, 25 bp, Artificial sequence
  Synthetic oligonucleotide
ggctgatttgcctgggctgattgaa

SEQ ID NO: 728704 - DNA, 25 bp, Artificial sequence
  Synthetic oligonucleotide
ggctgatttgccagggctgattgaa

SEQ ID NO: 728705 - DNA, 25 bp, Artificial sequence
  Synthetic oligonucleotide
aggcgtcggactgggccaccagttt

SEQ ID NO: 728706 - DNA, 25 bp, Artificial sequence
  Synthetic oligonucleotide
aggcgtcggactcggccaccagttt

SEQ ID NO: 728707 - DNA, 25 bp, Artificial sequence
  Synthetic oligonucleotide
tgaacggacgagcgttattgttcat

SEQ ID NO: 728708 - DNA, 25 bp, Artificial sequence
  Synthetic oligonucleotide
tgaacggacgagggttattgttcat

SEQ ID NO: 728709 - DNA, 25 bp, Artificial sequence
  Synthetic oligonucleotide
gtcaggcttagatggccgtgatcca

SEQ ID NO: 728710 - DNA, 25 bp, Artificial sequence
  Synthetic oligonucleotide
gtcaggcttagaaggccgtgatcca

SEQ ID NO: 728711 - DNA, 25 bp, Artificial sequence
  Synthetic oligonucleotide
tcttacgattaaccaggagctgagc

SEQ ID NO: 728712 - DNA, 25 bp, Artificial sequence
  Synthetic oligonucleotide
tcttacgattaagcaggagctgagc

SEQ ID NO: 728713 - DNA, 25 bp, Artificial sequence
  Synthetic oligonucleotide
ggactatcacttaacaacgcttgtc

SEQ ID NO: 728714 - DNA, 25 bp, Artificial sequence
  Synthetic oligonucleotide
tgggtgaaatgaggttgccgattca

SEQ ID NO: 728715 - DNA, 25 bp, Artificial sequence
  Synthetic oligonucleotide
gttatttaggtccagcagctacatt

SEQ ID NO: 728716 - DNA, 25 bp, Artificial sequence
  Synthetic oligonucleotide
cagtcagttcttgttttcaaaacgg

SEQ ID NO: 728717 - DNA, 25 bp, Artificial sequence
  Synthetic oligonucleotide
cagtcagttcttcttttcaaaacgg

SEQ ID NO: 728718 - DNA, 25 bp, Artificial sequence
  Synthetic oligonucleotide
ttgcttaccgcaccattccggagtg

SEQ ID NO: 728719 - DNA, 25 bp, Artificial sequence
  Synthetic oligonucleotide
ttgcttaccgcagcattccggagtg

SEQ ID NO: 728720 - DNA, 25 bp, Artificial sequence
  Synthetic oligonucleotide
ccgttgcaggcgtagttgattttgc

SEQ ID NO: 728721 - DNA, 25 bp, Artificial sequence
  Synthetic oligonucleotide
ccgttgcaggcgaagttgattttgc

SEQ ID NO: 728722 - DNA, 25 bp, Artificial sequence
  Synthetic oligonucleotide
tggaaaatgctttagaaggatctgt

SEQ ID NO: 728723 - DNA, 25 bp, Artificial sequence
  Synthetic oligonucleotide
tggaaaatgcttaagaaggatctgt

SEQ ID NO: 728724 - DNA, 25 bp, Artificial sequence
  Synthetic oligonucleotide
tagactatttaatacatgaacagcc

SEQ ID NO: 728725 - DNA, 25 bp, Artificial sequence
  Synthetic oligonucleotide
tattgattaatctatgttggctgaa

SEQ ID NO: 728726 - DNA, 25 bp, Artificial sequence
  Synthetic oligonucleotide
tgggtgaaatgacgttgccgattca

SEQ ID NO: 728727 - DNA, 25 bp, Artificial sequence
  Synthetic oligonucleotide
gtttgattttgttgaaaaggttgaa

SEQ ID NO: 728728 - DNA, 25 bp, Artificial sequence
  Synthetic oligonucleotide
tcgtccatccctcaagagagaatgc

SEQ ID NO: 728729 - DNA, 25 bp, Artificial sequence
  Synthetic oligonucleotide
tcgtccatccctgaagagagaatgc

SEQ ID NO: 728730 - DNA, 25 bp, Artificial sequence
  Synthetic oligonucleotide
tcgacaaaatttactcacattcaca

SEQ ID NO: 728731 - DNA, 25 bp, Artificial sequence
  Synthetic oligonucleotide
tcgacaaaattttctcacattcaca

SEQ ID NO: 728732 - DNA, 25 bp, Artificial sequence
  Synthetic oligonucleotide
aatgccataaatatcttcatcgaca

SEQ ID NO: 728733 - DNA, 25 bp, Artificial sequence
  Synthetic oligonucleotide
aatgccataaatttcttcatcgaca

SEQ ID NO: 728734 - DNA, 25 bp, Artificial sequence
  Synthetic oligonucleotide
ttccatatgaatacgccaattctac

SEQ ID NO: 728735 - DNA, 25 bp, Artificial sequence
  Synthetic oligonucleotide
ttccatatgaattcgccaattctac

SEQ ID NO: 728736 - DNA, 25 bp, Artificial sequence
  Synthetic oligonucleotide
caaagtttgtcactgaccatcccga

SEQ ID NO: 728737 - DNA, 25 bp, Artificial sequence
  Synthetic oligonucleotide
caaagtttgtcagtgaccatcccga

SEQ ID NO: 728738 - DNA, 25 bp, Artificial sequence
  Synthetic oligonucleotide
gggtcattgccaatgatatggcagc

SEQ ID NO: 728739 - DNA, 25 bp, Artificial sequence
  Synthetic oligonucleotide
tagactatttaaaacatgaacagcc

SEQ ID NO: 728740 - DNA, 25 bp, Artificial sequence
  Synthetic oligonucleotide
caccatggtaaatgaacaaattatc

SEQ ID NO: 728741 - DNA, 25 bp, Artificial sequence
  Synthetic oligonucleotide
tgtcattgcaagaggcggaagaggc

SEQ ID NO: 728742 - DNA, 25 bp, Artificial sequence
  Synthetic oligonucleotide
gtgccaggctctgtattttaaaggg

SEQ ID NO: 728743 - DNA, 25 bp, Artificial sequence
  Synthetic oligonucleotide
gaaagaggagacattttatcttgtc

SEQ ID NO: 728744 - DNA, 25 bp, Artificial sequence
  Synthetic oligonucleotide
gaaagaggagactttttatcttgtc

SEQ ID NO: 728745 - DNA, 25 bp, Artificial sequence
  Synthetic oligonucleotide
attgcccgatgcaatgagaaaaaca

SEQ ID NO: 728746 - DNA, 25 bp, Artificial sequence
  Synthetic oligonucleotide
attgcccgatgctatgagaaaaaca

SEQ ID NO: 728747 - DNA, 25 bp, Artificial sequence
  Synthetic oligonucleotide
aaagctgcttgatcgaaaaaaagca

SEQ ID NO: 728748 - DNA, 25 bp, Artificial sequence
  Synthetic oligonucleotide
aaagctgcttgaacgaaaaaaagca

SEQ ID NO: 728749 - DNA, 25 bp, Artificial sequence
  Synthetic oligonucleotide
agatgccgttcataaggtcgattta

SEQ ID NO: 728750 - DNA, 25 bp, Artificial sequence
  Synthetic oligonucleotide
agatgccgttcaaaaggtcgattta

SEQ ID NO: 728751 - DNA, 25 bp, Artificial sequence
  Synthetic oligonucleotide
gttttataaatagagggatgctgtt

SEQ ID NO: 728752 - DNA, 25 bp, Artificial sequence
  Synthetic oligonucleotide
aggtgcataaggcagagaaaatcgt

SEQ ID NO: 728753 - DNA, 25 bp, Artificial sequence
  Synthetic oligonucleotide
caccatggtaaaagaacaaattatc

SEQ ID NO: 728754 - DNA, 25 bp, Artificial sequence
  Synthetic oligonucleotide
gtttgattttgtagaaaaggttgaa

SEQ ID NO: 728755 - DNA, 25 bp, Artificial sequence
  Synthetic oligonucleotide
tcatttggaggataggtcaggtgcg

SEQ ID NO: 728756 - DNA, 25 bp, Artificial sequence
  Synthetic oligonucleotide
tcatttggaggaaaggtcaggtgcg

SEQ ID NO: 728757 - DNA, 25 bp, Artificial sequence
  Synthetic oligonucleotide
tcttcaggcggtagctgattctgga

SEQ ID NO: 728758 - DNA, 25 bp, Artificial sequence
  Synthetic oligonucleotide
tcttcaggcggttgctgattctgga

SEQ ID NO: 728759 - DNA, 25 bp, Artificial sequence
  Synthetic oligonucleotide
ttccattcaccacaccattccgctt

SEQ ID NO: 728760 - DNA, 25 bp, Artificial sequence
  Synthetic oligonucleotide
ttccattcaccagaccattccgctt

SEQ ID NO: 728761 - DNA, 25 bp, Artificial sequence
  Synthetic oligonucleotide
aaatgtgacactctctatcagtacg

SEQ ID NO: 728762 - DNA, 25 bp, Artificial sequence
  Synthetic oligonucleotide
aaatgtgacactgtctatcagtacg

SEQ ID NO: 728763 - DNA, 25 bp, Artificial sequence
  Synthetic oligonucleotide
agaagacattcatacattaatgaat

SEQ ID NO: 728764 - DNA, 25 bp, Artificial sequence
  Synthetic oligonucleotide
agaagacattcaaacattaatgaat

SEQ ID NO: 728765 - DNA, 25 bp, Artificial sequence
  Synthetic oligonucleotide
tattgattaatcaatgttggctgaa

SEQ ID NO: 728766 - DNA, 25 bp, Artificial sequence
  Synthetic oligonucleotide
gttttataaatacagggatgctgtt

SEQ ID NO: 728767 - DNA, 25 bp, Artificial sequence
  Synthetic oligonucleotide
gttatttaggtcgagcagctacatt

SEQ ID NO: 728768 - DNA, 25 bp, Artificial sequence
  Synthetic oligonucleotide
tatggttgcgttacgccgtgaaaaa

SEQ ID NO: 728769 - DNA, 25 bp, Artificial sequence
  Synthetic oligonucleotide
tgattttcacggggcctttgccgat

SEQ ID NO: 728770 - DNA, 25 bp, Artificial sequence
  Synthetic oligonucleotide
tgattttcacggcgcctttgccgat

SEQ ID NO: 728771 - DNA, 25 bp, Artificial sequence
  Synthetic oligonucleotide
tgatgatattcggcagaatggatat

SEQ ID NO: 728772 - DNA, 25 bp, Artificial sequence
  Synthetic oligonucleotide
tgatgatattcgccagaatggatat

SEQ ID NO: 728773 - DNA, 25 bp, Artificial sequence
  Synthetic oligonucleotide
tatcatgcgttttgaaatcacgagt

SEQ ID NO: 728774 - DNA, 25 bp, Artificial sequence
  Synthetic oligonucleotide
tatcatgcgtttagaaatcacgagt

SEQ ID NO: 728775 - DNA, 25 bp, Artificial sequence
  Synthetic oligonucleotide
gattgaaattggcttggactagcgg

SEQ ID NO: 728776 - DNA, 25 bp, Artificial sequence
  Synthetic oligonucleotide
gtttagaacggacgacattatgttt

SEQ ID NO: 728777 - DNA, 25 bp, Artificial sequence
  Synthetic oligonucleotide
gtttagaacggaggacattatgttt

SEQ ID NO: 728778 - DNA, 25 bp, Artificial sequence
  Synthetic oligonucleotide
caaagtatatgttaaaggcggcgac

SEQ ID NO: 728779 - DNA, 25 bp, Artificial sequence
  Synthetic oligonucleotide
caaagtatatgtaaaaggcggcgac

SEQ ID NO: 728780 - DNA, 25 bp, Artificial sequence
  Synthetic oligonucleotide
tatggttgcgtttcgccgtgaaaaa

SEQ ID NO: 728781 - DNA, 25 bp, Artificial sequence
  Synthetic oligonucleotide
gattgaaattgggttggactagcgg

SEQ ID NO: 728782 - DNA, 25 bp, Artificial sequence
  Synthetic oligonucleotide
aatccacgtaggaattacgtcagtt

SEQ ID NO: 728783 - DNA, 25 bp, Artificial sequence
  Synthetic oligonucleotide
tatcttttaccacttcgcgttgagt

SEQ ID NO: 728784 - DNA, 25 bp, Artificial sequence
  Synthetic oligonucleotide
ttttaggataaccgtacgacgcaaa

SEQ ID NO: 728785 - DNA, 25 bp, Artificial sequence
  Synthetic oligonucleotide
agttaatagcgaacgttcgtcaagt

SEQ ID NO: 728786 - DNA, 25 bp, Artificial sequence
  Synthetic oligonucleotide
agttaatagcgatcgttcgtcaagt

SEQ ID NO: 728787 - DNA, 25 bp, Artificial sequence
  Synthetic oligonucleotide
tattaaaatctatacggcgcccgat

SEQ ID NO: 728788 - DNA, 25 bp, Artificial sequence
  Synthetic oligonucleotide
tattaaaatctaaacggcgcccgat

SEQ ID NO: 728789 - DNA, 25 bp, Artificial sequence
  Synthetic oligonucleotide
cccaaagcgtaagtacgtaatatag

SEQ ID NO: 728790 - DNA, 25 bp, Artificial sequence
  Synthetic oligonucleotide
agccgatcggaccgtaataaattta

SEQ ID NO: 728791 - DNA, 25 bp, Artificial sequence
  Synthetic oligonucleotide
tatcttttaccagttcgcgttgagt

SEQ ID NO: 728792 - DNA, 25 bp, Artificial sequence
  Synthetic oligonucleotide
tccttatatcggccgtatatggtaa

SEQ ID NO: 728793 - DNA, 25 bp, Artificial sequence
  Synthetic oligonucleotide
aaaactacgatctcgcgtatactag

SEQ ID NO: 728794 - DNA, 25 bp, Artificial sequence
  Synthetic oligonucleotide
aaaactacgatcacgcgtatactag

SEQ ID NO: 728795 - DNA, 25 bp, Artificial sequence
  Synthetic oligonucleotide
ctagtaagtacgttacgctttgtct

SEQ ID NO: 728796 - DNA, 25 bp, Artificial sequence
  Synthetic oligonucleotide
ctagtaagtacgatacgctttgtct

SEQ ID NO: 728797 - DNA, 25 bp, Artificial sequence
  Synthetic oligonucleotide
tttgcctacgcaggattgtttttca

SEQ ID NO: 728798 - DNA, 25 bp, Artificial sequence
  Synthetic oligonucleotide
tttgcctacgcacgattgtttttca

SEQ ID NO: 728799 - DNA, 25 bp, Artificial sequence
  Synthetic oligonucleotide
cccaaagcgtaactacgtaatatag

SEQ ID NO: 728800 - DNA, 25 bp, Artificial sequence
  Synthetic oligonucleotide
gaggatttagcgacgactaattttc

SEQ ID NO: 728801 - DNA, 25 bp, Artificial sequence
  Synthetic oligonucleotide
cacaaaacgcggaatcgagaaatat

SEQ ID NO: 728802 - DNA, 25 bp, Artificial sequence
  Synthetic oligonucleotide
actcaatatttaccgcggatatcac

SEQ ID NO: 728803 - DNA, 25 bp, Artificial sequence
  Synthetic oligonucleotide
actcaatatttagcgcggatatcac

SEQ ID NO: 728804 - DNA, 25 bp, Artificial sequence
  Synthetic oligonucleotide
tataacccgcgttgtaatatcttcg

SEQ ID NO: 728805 - DNA, 25 bp, Artificial sequence
  Synthetic oligonucleotide
tataacccgcgtagtaatatcttcg

SEQ ID NO: 728806 - DNA, 25 bp, Artificial sequence
  Synthetic oligonucleotide
attataccgtcgtactaagtagtgg

SEQ ID NO: 728807 - DNA, 25 bp, Artificial sequence
  Synthetic oligonucleotide
ttttaggataacggtacgacgcaaa

SEQ ID NO: 728808 - DNA, 25 bp, Artificial sequence
  Synthetic oligonucleotide
gaggatttagcgtcgactaattttc

SEQ ID NO: 728809 - DNA, 25 bp, Artificial sequence
  Synthetic oligonucleotide
tccttatatcgggcgtatatggtaa

SEQ ID NO: 728810 - DNA, 25 bp, Artificial sequence
  Synthetic oligonucleotide
cttaaactaacgacgcttaccgata

SEQ ID NO: 728811 - DNA, 25 bp, Artificial sequence
  Synthetic oligonucleotide
cttaaactaacgtcgcttaccgata

SEQ ID NO: 728812 - DNA, 25 bp, Artificial sequence
  Synthetic oligonucleotide
gaatttgtcgacacgatactgaaca

SEQ ID NO: 728813 - DNA, 25 bp, Artificial sequence
  Synthetic oligonucleotide
gaatttgtcgactcgatactgaaca

SEQ ID NO: 728814 - DNA, 25 bp, Artificial sequence
  Synthetic oligonucleotide
tgtaccatacgagcgttacattcta

SEQ ID NO: 728815 - DNA, 25 bp, Artificial sequence
  Synthetic oligonucleotide
tgtaccatacgaccgttacattcta

SEQ ID NO: 728816 - DNA, 25 bp, Artificial sequence
  Synthetic oligonucleotide
taatgatcctacgcgactaatacga

SEQ ID NO: 728817 - DNA, 25 bp, Artificial sequence
  Synthetic oligonucleotide
attataccgtcgaactaagtagtgg

SEQ ID NO: 728818 - DNA, 25 bp, Artificial sequence
  Synthetic oligonucleotide
tatcaaatatagaccgcgacactct

SEQ ID NO: 728819 - DNA, 25 bp, Artificial sequence
  Synthetic oligonucleotide
tacaaacgatagaacgaccctatca

SEQ ID NO: 728820 - DNA, 25 bp, Artificial sequence
  Synthetic oligonucleotide
attgaacattgtatcgcgtctttgg

SEQ ID NO: 728821 - DNA, 25 bp, Artificial sequence
  Synthetic oligonucleotide
attgaacattgtttcgcgtctttgg

SEQ ID NO: 728822 - DNA, 25 bp, Artificial sequence
  Synthetic oligonucleotide
aacacagggtaaacgtcgtacaaat

SEQ ID NO: 728823 - DNA, 25 bp, Artificial sequence
  Synthetic oligonucleotide
aacacagggtaatcgtcgtacaaat

SEQ ID NO: 728824 - DNA, 25 bp, Artificial sequence
  Synthetic oligonucleotide
caataagatataggcgtcgctttca

SEQ ID NO: 728825 - DNA, 25 bp, Artificial sequence
  Synthetic oligonucleotide
aaccaataacgtatgccgcattgaa

SEQ ID NO: 728826 - DNA, 25 bp, Artificial sequence
  Synthetic oligonucleotide
tatcaaatatagtccgcgacactct

SEQ ID NO: 728827 - DNA, 25 bp, Artificial sequence
  Synthetic oligonucleotide
tatcagagtccgtcgtaaattccat

SEQ ID NO: 728828 - DNA, 25 bp, Artificial sequence
  Synthetic oligonucleotide
taagttgtatcgcgccgatttagat

SEQ ID NO: 728829 - DNA, 25 bp, Artificial sequence
  Synthetic oligonucleotide
taagttgtatcgggccgatttagat

SEQ ID NO: 728830 - DNA, 25 bp, Artificial sequence
  Synthetic oligonucleotide
ataaagtatcgccaatcctgctatc

SEQ ID NO: 728831 - DNA, 25 bp, Artificial sequence
  Synthetic oligonucleotide
ataaagtatcgcgaatcctgctatc

SEQ ID NO: 728832 - DNA, 25 bp, Artificial sequence
  Synthetic oligonucleotide
acatctcggataacgccttgtttaa

SEQ ID NO: 728833 - DNA, 25 bp, Artificial sequence
  Synthetic oligonucleotide
acatctcggatatcgccttgtttaa

SEQ ID NO: 728834 - DNA, 25 bp, Artificial sequence
  Synthetic oligonucleotide
tgttaaaataccctcgcgtttcgaa

SEQ ID NO: 728835 - DNA, 25 bp, Artificial sequence
  Synthetic oligonucleotide
caataagatatacgcgtcgctttca

SEQ ID NO: 728836 - DNA, 25 bp, Artificial sequence
  Synthetic oligonucleotide
ctgaaatcgcgctcgattaaaaatg

SEQ ID NO: 728837 - DNA, 25 bp, Artificial sequence
  Synthetic oligonucleotide
tgttaaaataccgtcgcgtttcgaa

SEQ ID NO: 728838 - DNA, 25 bp, Artificial sequence
  Synthetic oligonucleotide
taatgatcctacccgactaatacga

SEQ ID NO: 728839 - DNA, 25 bp, Artificial sequence
  Synthetic oligonucleotide
tagaattcgcctatacgagttcctt

SEQ ID NO: 728840 - DNA, 25 bp, Artificial sequence
  Synthetic oligonucleotide
tagaattcgcctttacgagttcctt

SEQ ID NO: 728841 - DNA, 25 bp, Artificial sequence
  Synthetic oligonucleotide
aagtcatagcgttatcgcaccatta

SEQ ID NO: 728842 - DNA, 25 bp, Artificial sequence
  Synthetic oligonucleotide
aagtcatagcgtaatcgcaccatta

SEQ ID NO: 728843 - DNA, 25 bp, Artificial sequence
  Synthetic oligonucleotide
aaccaataacgtttgccgcattgaa

SEQ ID NO: 728844 - DNA, 25 bp, Artificial sequence
  Synthetic oligonucleotide
tttactcggcgtgcgatattactta

SEQ ID NO: 728845 - DNA, 25 bp, Artificial sequence
  Synthetic oligonucleotide
tacaaacgatagtacgaccctatca

SEQ ID NO: 728846 - DNA, 25 bp, Artificial sequence
  Synthetic oligonucleotide
aatccacgtaggtattacgtcagtt

SEQ ID NO: 728847 - DNA, 25 bp, Artificial sequence
  Synthetic oligonucleotide
agccgatcggacggtaataaattta

SEQ ID NO: 728848 - DNA, 25 bp, Artificial sequence
  Synthetic oligonucleotide
ttgtactcgaagtaacgcgtatgtt

SEQ ID NO: 728849 - DNA, 25 bp, Artificial sequence
  Synthetic oligonucleotide
ttgtactcgaagaaacgcgtatgtt

SEQ ID NO: 728850 - DNA, 25 bp, Artificial sequence
  Synthetic oligonucleotide
caattaacatcgcgctaaacatgga

SEQ ID NO: 728851 - DNA, 25 bp, Artificial sequence
  Synthetic oligonucleotide
caattaacatcgggctaaacatgga

SEQ ID NO: 728852 - DNA, 25 bp, Artificial sequence
  Synthetic oligonucleotide
tatcagagtccgacgtaaattccat

SEQ ID NO: 728853 - DNA, 25 bp, Artificial sequence
  Synthetic oligonucleotide
tttactcggcgtccgatattactta

SEQ ID NO: 728854 - DNA, 25 bp, Artificial sequence
  Synthetic oligonucleotide
cttttgcttattagcgcgacttagt

SEQ ID NO: 728855 - DNA, 25 bp, Artificial sequence
  Synthetic oligonucleotide
acataatcgcacgcgtttatgtcta

SEQ ID NO: 728856 - DNA, 25 bp, Artificial sequence
  Synthetic oligonucleotide
aaggtccgcgaattagtgacatttt

SEQ ID NO: 728857 - DNA, 25 bp, Artificial sequence
  Synthetic oligonucleotide
actaatgcgtatatcgatcccctat

SEQ ID NO: 728858 - DNA, 25 bp, Artificial sequence
  Synthetic oligonucleotide
actaatgcgtatttcgatcccctat

SEQ ID NO: 728859 - DNA, 25 bp, Artificial sequence
  Synthetic oligonucleotide
aatgttcttatagcgcggtcacata

SEQ ID NO: 728860 - DNA, 25 bp, Artificial sequence
  Synthetic oligonucleotide
aatgttcttataccgcggtcacata

SEQ ID NO: 728861 - DNA, 25 bp, Artificial sequence
  Synthetic oligonucleotide
aaatcaataggccacgtaacatagc

SEQ ID NO: 728862 - DNA, 25 bp, Artificial sequence
  Synthetic oligonucleotide
aaggtgaatatgggcgtcgtaaata

SEQ ID NO: 728863 - DNA, 25 bp, Artificial sequence
  Synthetic oligonucleotide
aaatcaataggcgacgtaacatagc

SEQ ID NO: 728864 - DNA, 25 bp, Artificial sequence
  Synthetic oligonucleotide
cttttgcttatttgcgcgacttagt

SEQ ID NO: 728865 - DNA, 25 bp, Artificial sequence
  Synthetic oligonucleotide
attgccccgaacgtacttattatag

SEQ ID NO: 728866 - DNA, 25 bp, Artificial sequence
  Synthetic oligonucleotide
attgccccgaacctacttattatag

SEQ ID NO: 728867 - DNA, 25 bp, Artificial sequence
  Synthetic oligonucleotide
ttataaaccgagtagatcggatacg

SEQ ID NO: 728868 - DNA, 25 bp, Artificial sequence
  Synthetic oligonucleotide
ttataaaccgagaagatcggatacg

SEQ ID NO: 728869 - DNA, 25 bp, Artificial sequence
  Synthetic oligonucleotide
agatctgcgaccattcgtactaata

SEQ ID NO: 728870 - DNA, 25 bp, Artificial sequence
  Synthetic oligonucleotide
aaggtgaatatgcgcgtcgtaaata

SEQ ID NO: 728871 - DNA, 25 bp, Artificial sequence
  Synthetic oligonucleotide
tagttgacgtaaggtcgtaagtttg

SEQ ID NO: 728872 - DNA, 25 bp, Artificial sequence
  Synthetic oligonucleotide
cgtttttcacgagccgtatattgta

SEQ ID NO: 728873 - DNA, 25 bp, Artificial sequence
  Synthetic oligonucleotide
atcattgtacgtggcgtaagtattc

SEQ ID NO: 728874 - DNA, 25 bp, Artificial sequence
  Synthetic oligonucleotide
atcattgtacgtcgcgtaagtattc

SEQ ID NO: 728875 - DNA, 25 bp, Artificial sequence
  Synthetic oligonucleotide
tgctctacgtacgttacgagtaaaa

SEQ ID NO: 728876 - DNA, 25 bp, Artificial sequence
  Synthetic oligonucleotide
tgctctacgtaccttacgagtaaaa

SEQ ID NO: 728877 - DNA, 25 bp, Artificial sequence
  Synthetic oligonucleotide
aacaagacggttatacgtcaacaca

SEQ ID NO: 728878 - DNA, 25 bp, Artificial sequence
  Synthetic oligonucleotide
aaggtccgcgaaatagtgacatttt

SEQ ID NO: 728879 - DNA, 25 bp, Artificial sequence
  Synthetic oligonucleotide
tagttgacgtaacgtcgtaagtttg

SEQ ID NO: 728880 - DNA, 25 bp, Artificial sequence
  Synthetic oligonucleotide
gagaatacgcacgatactaaactca

SEQ ID NO: 728881 - DNA, 25 bp, Artificial sequence
  Synthetic oligonucleotide
tactagcgcgattatagtcacactt

SEQ ID NO: 728882 - DNA, 25 bp, Artificial sequence
  Synthetic oligonucleotide
tactagcgcgataatagtcacactt

SEQ ID NO: 728883 - DNA, 25 bp, Artificial sequence
  Synthetic oligonucleotide
tttcgttatcgctcgatagcttatc

SEQ ID NO: 728884 - DNA, 25 bp, Artificial sequence
  Synthetic oligonucleotide
tttcgttatcgcacgatagcttatc

SEQ ID NO: 728885 - DNA, 25 bp, Artificial sequence
  Synthetic oligonucleotide
gattaaatatgaggcgcgaaagatg

SEQ ID NO: 728886 - DNA, 25 bp, Artificial sequence
  Synthetic oligonucleotide
gattaaatatgacgcgcgaaagatg

SEQ ID NO: 728887 - DNA, 25 bp, Artificial sequence
  Synthetic oligonucleotide
aacaagacggttttacgtcaacaca

SEQ ID NO: 728888 - DNA, 25 bp, Artificial sequence
  Synthetic oligonucleotide
atttacaacgtaggatcgaccatga

SEQ ID NO: 728889 - DNA, 25 bp, Artificial sequence
  Synthetic oligonucleotide
gaaacacgtatttcgacctcacaat

SEQ ID NO: 728890 - DNA, 25 bp, Artificial sequence
  Synthetic oligonucleotide
cgaataagattagtcgcgaacattc

SEQ ID NO: 728891 - DNA, 25 bp, Artificial sequence
  Synthetic oligonucleotide
cgaataagattactcgcgaacattc

SEQ ID NO: 728892 - DNA, 25 bp, Artificial sequence
  Synthetic oligonucleotide
gaaaccacgattgatacgctgtaat

SEQ ID NO: 728893 - DNA, 25 bp, Artificial sequence
  Synthetic oligonucleotide
gaaaccacgattcatacgctgtaat

SEQ ID NO: 728894 - DNA, 25 bp, Artificial sequence
  Synthetic oligonucleotide
agcaaacgtactataacggctctaa

SEQ ID NO: 728895 - DNA, 25 bp, Artificial sequence
  Synthetic oligonucleotide
agatctgcgacctttcgtactaata

SEQ ID NO: 728896 - DNA, 25 bp, Artificial sequence
  Synthetic oligonucleotide
atttacaacgtacgatcgaccatga

SEQ ID NO: 728897 - DNA, 25 bp, Artificial sequence
  Synthetic oligonucleotide
tagatttagagccttacgccatcta

SEQ ID NO: 728898 - DNA, 25 bp, Artificial sequence
  Synthetic oligonucleotide
tgagtaggacgccttatatgaatca

SEQ ID NO: 728899 - DNA, 25 bp, Artificial sequence
  Synthetic oligonucleotide
tgagtaggacgcgttatatgaatca

SEQ ID NO: 728900 - DNA, 25 bp, Artificial sequence
  Synthetic oligonucleotide
tattggcgcgtcgttattagaagaa

SEQ ID NO: 728901 - DNA, 25 bp, Artificial sequence
  Synthetic oligonucleotide
tattggcgcgtccttattagaagaa

SEQ ID NO: 728902 - DNA, 25 bp, Artificial sequence
  Synthetic oligonucleotide
gcattattcataggacgcagtactt

SEQ ID NO: 728903 - DNA, 25 bp, Artificial sequence
  Synthetic oligonucleotide
accaccatagatcgtcgcaatttaa

SEQ ID NO: 728904 - DNA, 25 bp, Artificial sequence
  Synthetic oligonucleotide
agcaaacgtactttaacggctctaa

SEQ ID NO: 728905 - DNA, 25 bp, Artificial sequence
  Synthetic oligonucleotide
agttagtgtcggttagacgttatac

SEQ ID NO: 728906 - DNA, 25 bp, Artificial sequence
  Synthetic oligonucleotide
tttgtccgtatgacgaaccaataag

SEQ ID NO: 728907 - DNA, 25 bp, Artificial sequence
  Synthetic oligonucleotide
accatcatacgcaatcgtcttaagt

SEQ ID NO: 728908 - DNA, 25 bp, Artificial sequence
  Synthetic oligonucleotide
accatcatacgctatcgtcttaagt

SEQ ID NO: 728909 - DNA, 25 bp, Artificial sequence
  Synthetic oligonucleotide
gagagacgcgctagtatataagttt

SEQ ID NO: 728910 - DNA, 25 bp, Artificial sequence
  Synthetic oligonucleotide
gagagacgcgcttgtatataagttt

SEQ ID NO: 728911 - DNA, 25 bp, Artificial sequence
  Synthetic oligonucleotide
agaatgcgtaaccttacggaatctt

SEQ ID NO: 728912 - DNA, 25 bp, Artificial sequence
  Synthetic oligonucleotide
gaaacacgtattacgacctcacaat

SEQ ID NO: 728913 - DNA, 25 bp, Artificial sequence
  Synthetic oligonucleotide
agttagtgtcggatagacgttatac

SEQ ID NO: 728914 - DNA, 25 bp, Artificial sequence
  Synthetic oligonucleotide
tagatttagagcgttacgccatcta

SEQ ID NO: 728915 - DNA, 25 bp, Artificial sequence
  Synthetic oligonucleotide
gttagaatattccatcgcgttcgat

SEQ ID NO: 728916 - DNA, 25 bp, Artificial sequence
  Synthetic oligonucleotide
gttagaatattcgatcgcgttcgat

SEQ ID NO: 728917 - DNA, 25 bp, Artificial sequence
  Synthetic oligonucleotide
caacagcgcgtaactcgaaaaaaat

SEQ ID NO: 728918 - DNA, 25 bp, Artificial sequence
  Synthetic oligonucleotide
caacagcgcgtatctcgaaaaaaat

SEQ ID NO: 728919 - DNA, 25 bp, Artificial sequence
  Synthetic oligonucleotide
ataaaaggcgttagtcgaagcatca

SEQ ID NO: 728920 - DNA, 25 bp, Artificial sequence
  Synthetic oligonucleotide
ataaaaggcgtttgtcgaagcatca

SEQ ID NO: 728921 - DNA, 25 bp, Artificial sequence
  Synthetic oligonucleotide
gagaatacgcaccatactaaactca

SEQ ID NO: 728922 - DNA, 25 bp, Artificial sequence
  Synthetic oligonucleotide
agaatgcgtaacgttacggaatctt

SEQ ID NO: 728923 - DNA, 25 bp, Artificial sequence
  Synthetic oligonucleotide
ttagtgttatacgcgtaggtttgac

SEQ ID NO: 728924 - DNA, 25 bp, Artificial sequence
  Synthetic oligonucleotide
gttttgcgtatcgtaacgtattcga

SEQ ID NO: 728925 - DNA, 25 bp, Artificial sequence
  Synthetic oligonucleotide
caaaccttacctggacgtatactta

SEQ ID NO: 728926 - DNA, 25 bp, Artificial sequence
  Synthetic oligonucleotide
caaaccttacctcgacgtatactta

SEQ ID NO: 728927 - DNA, 25 bp, Artificial sequence
  Synthetic oligonucleotide
atacactcgcgacagactagataaa

SEQ ID NO: 728928 - DNA, 25 bp, Artificial sequence
  Synthetic oligonucleotide
atacactcgcgagagactagataaa

SEQ ID NO: 728929 - DNA, 25 bp, Artificial sequence
  Synthetic oligonucleotide
atattgtaacgcaagacgctatacc

SEQ ID NO: 728930 - DNA, 25 bp, Artificial sequence
  Synthetic oligonucleotide
ctagttgatctaggcgctattgtta

SEQ ID NO: 728931 - DNA, 25 bp, Artificial sequence
  Synthetic oligonucleotide
ttagtgttatacccgtaggtttgac

SEQ ID NO: 728932 - DNA, 25 bp, Artificial sequence
  Synthetic oligonucleotide
gacataatattcgacggacagatag

SEQ ID NO: 728933 - DNA, 25 bp, Artificial sequence
  Synthetic oligonucleotide
tattatctatactcgaacgagccga

SEQ ID NO: 728934 - DNA, 25 bp, Artificial sequence
  Synthetic oligonucleotide
tattatctatacacgaacgagccga

SEQ ID NO: 728935 - DNA, 25 bp, Artificial sequence
  Synthetic oligonucleotide
aatagcttcgcgtaactacagatga

SEQ ID NO: 728936 - DNA, 25 bp, Artificial sequence
  Synthetic oligonucleotide
aatagcttcgcgaaactacagatga

SEQ ID NO: 728937 - DNA, 25 bp, Artificial sequence
  Synthetic oligonucleotide
tgactacgacgtacgtacagtattt

SEQ ID NO: 728938 - DNA, 25 bp, Artificial sequence
  Synthetic oligonucleotide
cgtttttcacgacccgtatattgta

SEQ ID NO: 728939 - DNA, 25 bp, Artificial sequence
  Synthetic oligonucleotide
atattgtaacgctagacgctatacc

SEQ ID NO: 728940 - DNA, 25 bp, Artificial sequence
  Synthetic oligonucleotide
taactgtacgcgttctaagtagtag

SEQ ID NO: 728941 - DNA, 25 bp, Artificial sequence
  Synthetic oligonucleotide
cacaaaacgcggtatcgagaaatat

SEQ ID NO: 728942 - DNA, 25 bp, Artificial sequence
  Synthetic oligonucleotide
aggactcgtcctatctacgaatatt

SEQ ID NO: 728943 - DNA, 25 bp, Artificial sequence
  Synthetic oligonucleotide
aggactcgtcctttctacgaatatt

SEQ ID NO: 728944 - DNA, 25 bp, Artificial sequence
  Synthetic oligonucleotide
tataacaggtacgttacgcagtttg

SEQ ID NO: 728945 - DNA, 25 bp, Artificial sequence
  Synthetic oligonucleotide
tataacaggtaccttacgcagtttg

SEQ ID NO: 728946 - DNA, 25 bp, Artificial sequence
  Synthetic oligonucleotide
ccatatcttagtacgcgaaccaata

SEQ ID NO: 728947 - DNA, 25 bp, Artificial sequence
  Synthetic oligonucleotide
gttttgcgtatcctaacgtattcga

SEQ ID NO: 728948 - DNA, 25 bp, Artificial sequence
  Synthetic oligonucleotide
taactgtacgcgatctaagtagtag

SEQ ID NO: 728949 - DNA, 25 bp, Artificial sequence
  Synthetic oligonucleotide
gacataatattccacggacagatag

SEQ ID NO: 728950 - DNA, 25 bp, Artificial sequence
  Synthetic oligonucleotide
cattattacggtgggtacagattac

SEQ ID NO: 728951 - DNA, 25 bp, Artificial sequence
  Synthetic oligonucleotide
cattattacggtcggtacagattac

SEQ ID NO: 728952 - DNA, 25 bp, Artificial sequence
  Synthetic oligonucleotide
ctgtgttagtaccagcgattgattt

SEQ ID NO: 728953 - DNA, 25 bp, Artificial sequence
  Synthetic oligonucleotide
ctgtgttagtacgagcgattgattt

SEQ ID NO: 728954 - DNA, 25 bp, Artificial sequence
  Synthetic oligonucleotide
tatgcttatctcgcgattagtgatg

SEQ ID NO: 728955 - DNA, 25 bp, Artificial sequence
  Synthetic oligonucleotide
tatgcttatctcccgattagtgatg

SEQ ID NO: 728956 - DNA, 25 bp, Artificial sequence
  Synthetic oligonucleotide
ctagttgatctacgcgctattgtta

SEQ ID NO: 728957 - DNA, 25 bp, Artificial sequence
  Synthetic oligonucleotide
ccatatcttagttcgcgaaccaata

SEQ ID NO: 728958 - DNA, 25 bp, Artificial sequence
  Synthetic oligonucleotide
ctctaccggctttatacgaatactt

SEQ ID NO: 728959 - DNA, 25 bp, Artificial sequence
  Synthetic oligonucleotide
cgtaaaacgcgtaactatcactatg

SEQ ID NO: 728960 - DNA, 25 bp, Artificial sequence
  Synthetic oligonucleotide
cgtaaaacgcgttactatcactatg

SEQ ID NO: 728961 - DNA, 25 bp, Artificial sequence
  Synthetic oligonucleotide
gatctgcgttacgcgttattaaatg

SEQ ID NO: 728962 - DNA, 25 bp, Artificial sequence
  Synthetic oligonucleotide
gatctgcgttacccgttattaaatg

SEQ ID NO: 728963 - DNA, 25 bp, Artificial sequence
  Synthetic oligonucleotide
aaaaagaccgcgaaaagtgtcaatc

SEQ ID NO: 728964 - DNA, 25 bp, Artificial sequence
  Synthetic oligonucleotide
aaaaagaccgcgtaaagtgtcaatc

SEQ ID NO: 728965 - DNA, 25 bp, Artificial sequence
  Synthetic oligonucleotide
tgactacgacgttcgtacagtattt

SEQ ID NO: 728966 - DNA, 25 bp, Artificial sequence
  Synthetic oligonucleotide
tagttctgcggttacgatagcaatt

SEQ ID NO: 728967 - DNA, 25 bp, Artificial sequence
  Synthetic oligonucleotide
caacagtaacgttaaggcgttgata

SEQ ID NO: 728968 - DNA, 25 bp, Artificial sequence
  Synthetic oligonucleotide
ctctaccggcttaatacgaatactt

SEQ ID NO: 728969 - DNA, 25 bp, Artificial sequence
  Synthetic oligonucleotide
atcatgggtcgttatacgtaagtag

SEQ ID NO: 728970 - DNA, 25 bp, Artificial sequence
  Synthetic oligonucleotide
atcatgggtcgtaatacgtaagtag

SEQ ID NO: 728971 - DNA, 25 bp, Artificial sequence
  Synthetic oligonucleotide
caagatagtctaatacgcgcataag

SEQ ID NO: 728972 - DNA, 25 bp, Artificial sequence
  Synthetic oligonucleotide
caagatagtctattacgcgcataag

SEQ ID NO: 728973 - DNA, 25 bp, Artificial sequence
  Synthetic oligonucleotide
acataatcgcacccgtttatgtcta

SEQ ID NO: 728974 - DNA, 25 bp, Artificial sequence
  Synthetic oligonucleotide
tagttctgcggtaacgatagcaatt

SEQ ID NO: 728975 - DNA, 25 bp, Artificial sequence
  Synthetic oligonucleotide
tacccacgctatattagcgaaaaag

SEQ ID NO: 728976 - DNA, 25 bp, Artificial sequence
  Synthetic oligonucleotide
aattaagtctaccgcgtcacaagat

SEQ ID NO: 728977 - DNA, 25 bp, Artificial sequence
  Synthetic oligonucleotide
aattaagtctacggcgtcacaagat

SEQ ID NO: 728978 - DNA, 25 bp, Artificial sequence
  Synthetic oligonucleotide
acattgacccgatcgtttaactcta

SEQ ID NO: 728979 - DNA, 25 bp, Artificial sequence
  Synthetic oligonucleotide
acattgacccgaacgtttaactcta

SEQ ID NO: 728980 - DNA, 25 bp, Artificial sequence
  Synthetic oligonucleotide
actaaccgcacgataagtaagagtt

SEQ ID NO: 728981 - DNA, 25 bp, Artificial sequence
  Synthetic oligonucleotide
actaaccgcacgttaagtaagagtt

SEQ ID NO: 728982 - DNA, 25 bp, Artificial sequence
  Synthetic oligonucleotide
atcctgtgtcgaaccgttaaaatga

SEQ ID NO: 728983 - DNA, 25 bp, Artificial sequence
  Synthetic oligonucleotide
cgctagcgcgaataggtatttatat

SEQ ID NO: 728984 - DNA, 25 bp, Artificial sequence
  Synthetic oligonucleotide
atcctgtgtcgatccgttaaaatga

SEQ ID NO: 728985 - DNA, 25 bp, Artificial sequence
  Synthetic oligonucleotide
tacccacgctattttagcgaaaaag

SEQ ID NO: 728986 - DNA, 25 bp, Artificial sequence
  Synthetic oligonucleotide
taaatccgttgccatacggttgata

SEQ ID NO: 728987 - DNA, 25 bp, Artificial sequence
  Synthetic oligonucleotide
taaatccgttgcgatacggttgata

SEQ ID NO: 728988 - DNA, 25 bp, Artificial sequence
  Synthetic oligonucleotide
cacaatatgtcgggagatagtatgt

SEQ ID NO: 728989 - DNA, 25 bp, Artificial sequence
  Synthetic oligonucleotide
cacaatatgtcgcgagatagtatgt

SEQ ID NO: 728990 - DNA, 25 bp, Artificial sequence
  Synthetic oligonucleotide
caacagtaacgtaaaggcgttgata

SEQ ID NO: 728991 - DNA, 25 bp, Artificial sequence
  Synthetic oligonucleotide
tttgtccgtatgtcgaaccaataag

SEQ ID NO: 728992 - DNA, 25 bp, Artificial sequence
  Synthetic oligonucleotide
cgctagcgcgaaaaggtatttatat

SEQ ID NO: 728993 - DNA, 25 bp, Artificial sequence
  Synthetic oligonucleotide
ttgtctgttctcggttacgactata

SEQ ID NO: 728994 - DNA, 25 bp, Artificial sequence
  Synthetic oligonucleotide
gcattattcatacgacgcagtactt

SEQ ID NO: 728995 - DNA, 25 bp, Artificial sequence
  Synthetic oligonucleotide
cacattacgcgttgaacgatattgt

SEQ ID NO: 728996 - DNA, 25 bp, Artificial sequence
  Synthetic oligonucleotide
cacattacgcgtagaacgatattgt

SEQ ID NO: 728997 - DNA, 25 bp, Artificial sequence
  Synthetic oligonucleotide
tagttttatagctgacgcgcattca

SEQ ID NO: 728998 - DNA, 25 bp, Artificial sequence
  Synthetic oligonucleotide
tagttttatagcagacgcgcattca

SEQ ID NO: 728999 - DNA, 25 bp, Artificial sequence
  Synthetic oligonucleotide
ggtatacgcgataatacgcgtttaa

SEQ ID NO: 729000 - DNA, 25 bp, Artificial sequence
  Synthetic oligonucleotide
aagtaatagaacgcgatacaggctt

SEQ ID NO: 729001 - DNA, 25 bp, Artificial sequence
  Synthetic oligonucleotide
ttgtctgttctccgttacgactata

SEQ ID NO: 729002 - DNA, 25 bp, Artificial sequence
  Synthetic oligonucleotide
aaacagtactagagtcgcgattatc

SEQ ID NO: 729003 - DNA, 25 bp, Artificial sequence
  Synthetic oligonucleotide
atagatgtatacgcttcgactgtag

SEQ ID NO: 729004 - DNA, 25 bp, Artificial sequence
  Synthetic oligonucleotide
atagatgtatacccttcgactgtag

SEQ ID NO: 729005 - DNA, 25 bp, Artificial sequence
  Synthetic oligonucleotide
ataatagaatctcgtacgctacctc

SEQ ID NO: 729006 - DNA, 25 bp, Artificial sequence
  Synthetic oligonucleotide
ataatagaatctggtacgctacctc

SEQ ID NO: 729007 - DNA, 25 bp, Artificial sequence
  Synthetic oligonucleotide
caaatagttcgaggtacgacgattt

SEQ ID NO: 729008 - DNA, 25 bp, Artificial sequence
  Synthetic oligonucleotide
caaatagttcgacgtacgacgattt

SEQ ID NO: 729009 - DNA, 25 bp, Artificial sequence
  Synthetic oligonucleotide
ggtatacgcgattatacgcgtttaa

SEQ ID NO: 729010 - DNA, 25 bp, Artificial sequence
  Synthetic oligonucleotide
gttatgtagtattcgcgcactactt

SEQ ID NO: 729011 - DNA, 25 bp, Artificial sequence
  Synthetic oligonucleotide
aactaaacgataagtcgcgaagaca

SEQ ID NO: 729012 - DNA, 25 bp, Artificial sequence
  Synthetic oligonucleotide
aactaaacgatatgtcgcgaagaca

SEQ ID NO: 729013 - DNA, 25 bp, Artificial sequence
  Synthetic oligonucleotide
atactaatcacgcgcgtaaaatcct

SEQ ID NO: 729014 - DNA, 25 bp, Artificial sequence
  Synthetic oligonucleotide
atactaatcacgggcgtaaaatcct

SEQ ID NO: 729015 - DNA, 25 bp, Artificial sequence
  Synthetic oligonucleotide
gtctgccgtgcgttaatctatattt

SEQ ID NO: 729016 - DNA, 25 bp, Artificial sequence
  Synthetic oligonucleotide
gtctgccgtgcgataatctatattt

SEQ ID NO: 729017 - DNA, 25 bp, Artificial sequence
  Synthetic oligonucleotide
aagtaatagaacccgatacaggctt

SEQ ID NO: 729018 - DNA, 25 bp, Artificial sequence
  Synthetic oligonucleotide
tgtatggttcgaatagtcgaatcga

SEQ ID NO: 729019 - DNA, 25 bp, Artificial sequence
  Synthetic oligonucleotide
aagcttcgagtaacgatattctcga

SEQ ID NO: 729020 - DNA, 25 bp, Artificial sequence
  Synthetic oligonucleotide
gttatgtagtatacgcgcactactt

SEQ ID NO: 729021 - DNA, 25 bp, Artificial sequence
  Synthetic oligonucleotide
ttccctctaataagcgtcgtttcta

SEQ ID NO: 729022 - DNA, 25 bp, Artificial sequence
  Synthetic oligonucleotide
ttccctctaatatgcgtcgtttcta

SEQ ID NO: 729023 - DNA, 25 bp, Artificial sequence
  Synthetic oligonucleotide
atacaagtatcgtcgttgtgtgaga

SEQ ID NO: 729024 - DNA, 25 bp, Artificial sequence
  Synthetic oligonucleotide
atacaagtatcgacgttgtgtgaga

SEQ ID NO: 729025 - DNA, 25 bp, Artificial sequence
  Synthetic oligonucleotide
aaacagtactagtgtcgcgattatc

SEQ ID NO: 729026 - DNA, 25 bp, Artificial sequence
  Synthetic oligonucleotide
tgtatggttcgattagtcgaatcga

SEQ ID NO: 729027 - DNA, 25 bp, Artificial sequence
  Synthetic oligonucleotide
accgaaagttatcgctcgtttgtta

SEQ ID NO: 729028 - DNA, 25 bp, Artificial sequence
  Synthetic oligonucleotide
atcaattgtcgcgatctaatgcctt

SEQ ID NO: 729029 - DNA, 25 bp, Artificial sequence
  Synthetic oligonucleotide
atcaattgtcgccatctaatgcctt

SEQ ID NO: 729030 - DNA, 25 bp, Artificial sequence
  Synthetic oligonucleotide
ttctgacgttacaacggattagtac

SEQ ID NO: 729031 - DNA, 25 bp, Artificial sequence
  Synthetic oligonucleotide
ttctgacgttactacggattagtac

SEQ ID NO: 729032 - DNA, 25 bp, Artificial sequence
  Synthetic oligonucleotide
gatttaatatgtcgatccggactag

SEQ ID NO: 729033 - DNA, 25 bp, Artificial sequence
  Synthetic oligonucleotide
gatttaatatgtggatccggactag

SEQ ID NO: 729034 - DNA, 25 bp, Artificial sequence
  Synthetic oligonucleotide
gtttcagtactaaagcgcgtgttta

SEQ ID NO: 729035 - DNA, 25 bp, Artificial sequence
  Synthetic oligonucleotide
tcttaataacgtacgatcgaaggga

SEQ ID NO: 729036 - DNA, 25 bp, Artificial sequence
  Synthetic oligonucleotide
gttagttcgtatacgcgcaaaaaac

SEQ ID NO: 729037 - DNA, 25 bp, Artificial sequence
  Synthetic oligonucleotide
accgaaagttatggctcgtttgtta

SEQ ID NO: 729038 - DNA, 25 bp, Artificial sequence
  Synthetic oligonucleotide
caagaagcgcgttttgtaactgatt

SEQ ID NO: 729039 - DNA, 25 bp, Artificial sequence
  Synthetic oligonucleotide
caagaagcgcgtattgtaactgatt

SEQ ID NO: 729040 - DNA, 25 bp, Artificial sequence
  Synthetic oligonucleotide
tactgacgcgaactagttaacagaa

SEQ ID NO: 729041 - DNA, 25 bp, Artificial sequence
  Synthetic oligonucleotide
tactgacgcgaagtagttaacagaa

SEQ ID NO: 729042 - DNA, 25 bp, Artificial sequence
  Synthetic oligonucleotide
aaaagagttagtggtcgcagatcta

SEQ ID NO: 729043 - DNA, 25 bp, Artificial sequence
  Synthetic oligonucleotide
tcttaataacgttcgatcgaaggga

SEQ ID NO: 729044 - DNA, 25 bp, Artificial sequence
  Synthetic oligonucleotide
aaaagaggagtaggcgtaacatgta

SEQ ID NO: 729045 - DNA, 25 bp, Artificial sequence
  Synthetic oligonucleotide
ttagtagatagtggctacgtgatgt

SEQ ID NO: 729046 - DNA, 25 bp, Artificial sequence
  Synthetic oligonucleotide
aagcttcgagtatcgatattctcga

SEQ ID NO: 729047 - DNA, 25 bp, Artificial sequence
  Synthetic oligonucleotide
aaatgacgatactagacgttctcca

SEQ ID NO: 729048 - DNA, 25 bp, Artificial sequence
  Synthetic oligonucleotide
aaatgacgatacaagacgttctcca

SEQ ID NO: 729049 - DNA, 25 bp, Artificial sequence
  Synthetic oligonucleotide
cttattgtagttggtacgctcacat

SEQ ID NO: 729050 - DNA, 25 bp, Artificial sequence
  Synthetic oligonucleotide
cttattgtagttcgtacgctcacat

SEQ ID NO: 729051 - DNA, 25 bp, Artificial sequence
  Synthetic oligonucleotide
gatacccgttcgaactaatagtgtt

SEQ ID NO: 729052 - DNA, 25 bp, Artificial sequence
  Synthetic oligonucleotide
gaaatatacgacgctagtagatcac

SEQ ID NO: 729053 - DNA, 25 bp, Artificial sequence
  Synthetic oligonucleotide
gatacccgttcgtactaatagtgtt

SEQ ID NO: 729054 - DNA, 25 bp, Artificial sequence
  Synthetic oligonucleotide
aaaagaggagtacgcgtaacatgta

SEQ ID NO: 729055 - DNA, 25 bp, Artificial sequence
  Synthetic oligonucleotide
ttcatttaatcgtccgtcgcaatag

SEQ ID NO: 729056 - DNA, 25 bp, Artificial sequence
  Synthetic oligonucleotide
ttcatttaatcgaccgtcgcaatag

SEQ ID NO: 729057 - DNA, 25 bp, Artificial sequence
  Synthetic oligonucleotide
aaaagtcgtccaaagtcgatcatag

SEQ ID NO: 729058 - DNA, 25 bp, Artificial sequence
  Synthetic oligonucleotide
aaaagtcgtccatagtcgatcatag

SEQ ID NO: 729059 - DNA, 25 bp, Artificial sequence
  Synthetic oligonucleotide
gttagttcgtattcgcgcaaaaaac

SEQ ID NO: 729060 - DNA, 25 bp, Artificial sequence
  Synthetic oligonucleotide
gtttcagtactatagcgcgtgttta

SEQ ID NO: 729061 - DNA, 25 bp, Artificial sequence
  Synthetic oligonucleotide
gaaatatacgaccctagtagatcac

SEQ ID NO: 729062 - DNA, 25 bp, Artificial sequence
  Synthetic oligonucleotide
gtatcttatatgctcgcggaaaagt

SEQ ID NO: 729063 - DNA, 25 bp, Artificial sequence
  Synthetic oligonucleotide
aataagaacgcgaactcgtcaaaac

SEQ ID NO: 729064 - DNA, 25 bp, Artificial sequence
  Synthetic oligonucleotide
aataagaacgcgtactcgtcaaaac

SEQ ID NO: 729065 - DNA, 25 bp, Artificial sequence
  Synthetic oligonucleotide
atcatttcgcgaacgtaaacagaag

SEQ ID NO: 729066 - DNA, 25 bp, Artificial sequence
  Synthetic oligonucleotide
atcatttcgcgatcgtaaacagaag

SEQ ID NO: 729067 - DNA, 25 bp, Artificial sequence
  Synthetic oligonucleotide
tacataacgcgactagttagtctgt

SEQ ID NO: 729068 - DNA, 25 bp, Artificial sequence
  Synthetic oligonucleotide
tacataacgcgagtagttagtctgt

SEQ ID NO: 729069 - DNA, 25 bp, Artificial sequence
  Synthetic oligonucleotide
attagtcgccgtaataaccaccaaa

SEQ ID NO: 729070 - DNA, 25 bp, Artificial sequence
  Synthetic oligonucleotide
atgtgagtaacgttcgacaaacagt

SEQ ID NO: 729071 - DNA, 25 bp, Artificial sequence
  Synthetic oligonucleotide
taattatccgttgcgacgtgactat

SEQ ID NO: 729072 - DNA, 25 bp, Artificial sequence
  Synthetic oligonucleotide
gtatcttatatggtcgcggaaaagt

SEQ ID NO: 729073 - DNA, 25 bp, Artificial sequence
  Synthetic oligonucleotide
actcatctacggcacgtaattcata

SEQ ID NO: 729074 - DNA, 25 bp, Artificial sequence
  Synthetic oligonucleotide
actcatctacgggacgtaattcata

SEQ ID NO: 729075 - DNA, 25 bp, Artificial sequence
  Synthetic oligonucleotide
gtatctcgttatggacgctgtataa

SEQ ID NO: 729076 - DNA, 25 bp, Artificial sequence
  Synthetic oligonucleotide
gtatctcgttatcgacgctgtataa

SEQ ID NO: 729077 - DNA, 25 bp, Artificial sequence
  Synthetic oligonucleotide
gtcttatagtcaggattcgactaga

SEQ ID NO: 729078 - DNA, 25 bp, Artificial sequence
  Synthetic oligonucleotide
atgtgagtaacgatcgacaaacagt

SEQ ID NO: 729079 - DNA, 25 bp, Artificial sequence
  Synthetic oligonucleotide
tcaagatcgatttacgacgccttaa

SEQ ID NO: 729080 - DNA, 25 bp, Artificial sequence
  Synthetic oligonucleotide
attgaacacgtaaggcgtaccttta

SEQ ID NO: 729081 - DNA, 25 bp, Artificial sequence
  Synthetic oligonucleotide
attgaacacgtatggcgtaccttta

SEQ ID NO: 729082 - DNA, 25 bp, Artificial sequence
  Synthetic oligonucleotide
tttagcacgtaaaacgcggtttatc

SEQ ID NO: 729083 - DNA, 25 bp, Artificial sequence
  Synthetic oligonucleotide
tttagcacgtaatacgcggtttatc

SEQ ID NO: 729084 - DNA, 25 bp, Artificial sequence
  Synthetic oligonucleotide
acgtatcgttaagggtacggatata

SEQ ID NO: 729085 - DNA, 25 bp, Artificial sequence
  Synthetic oligonucleotide
acgtatcgttaacggtacggatata

SEQ ID NO: 729086 - DNA, 25 bp, Artificial sequence
  Synthetic oligonucleotide
gataaagtatcgtaacggctctcta

SEQ ID NO: 729087 - DNA, 25 bp, Artificial sequence
  Synthetic oligonucleotide
tgtttggtatcgcgcgttagttatt

SEQ ID NO: 729088 - DNA, 25 bp, Artificial sequence
  Synthetic oligonucleotide
gataaagtatcgaaacggctctcta

SEQ ID NO: 729089 - DNA, 25 bp, Artificial sequence
  Synthetic oligonucleotide
tcaagatcgattaacgacgccttaa

SEQ ID NO: 729090 - DNA, 25 bp, Artificial sequence
  Synthetic oligonucleotide
taagtacggcgctagtatatgtatc

SEQ ID NO: 729091 - DNA, 25 bp, Artificial sequence
  Synthetic oligonucleotide
taagtacggcgcaagtatatgtatc

SEQ ID NO: 729092 - DNA, 25 bp, Artificial sequence
  Synthetic oligonucleotide
gattctgattgcgcccataatgtaa

SEQ ID NO: 729093 - DNA, 25 bp, Artificial sequence
  Synthetic oligonucleotide
gattctgattgcccccataatgtaa

SEQ ID NO: 729094 - DNA, 25 bp, Artificial sequence
  Synthetic oligonucleotide
taattatccgttccgacgtgactat

SEQ ID NO: 729095 - DNA, 25 bp, Artificial sequence
  Synthetic oligonucleotide
catacttacgataagcgcgagaata

SEQ ID NO: 729096 - DNA, 25 bp, Artificial sequence
  Synthetic oligonucleotide
tgtttggtatcgggcgttagttatt

SEQ ID NO: 729097 - DNA, 25 bp, Artificial sequence
  Synthetic oligonucleotide
agtaattacggcgctactactactt

SEQ ID NO: 729098 - DNA, 25 bp, Artificial sequence
  Synthetic oligonucleotide
tattacacggttgcgcgttatgata

SEQ ID NO: 729099 - DNA, 25 bp, Artificial sequence
  Synthetic oligonucleotide
gagattcgtataggtcgcgaaaata

SEQ ID NO: 729100 - DNA, 25 bp, Artificial sequence
  Synthetic oligonucleotide
gagattcgtatacgtcgcgaaaata

SEQ ID NO: 729101 - DNA, 25 bp, Artificial sequence
  Synthetic oligonucleotide
catgtattgtcgcgaacgatcatat

SEQ ID NO: 729102 - DNA, 25 bp, Artificial sequence
  Synthetic oligonucleotide
catgtattgtcgggaacgatcatat

SEQ ID NO: 729103 - DNA, 25 bp, Artificial sequence
  Synthetic oligonucleotide
attatctagtataccgcgagtatgc

SEQ ID NO: 729104 - DNA, 25 bp, Artificial sequence
  Synthetic oligonucleotide
attagtcgccgttataaccaccaaa

SEQ ID NO: 729105 - DNA, 25 bp, Artificial sequence
  Synthetic oligonucleotide
agtaattacggccctactactactt

SEQ ID NO: 729106 - DNA, 25 bp, Artificial sequence
  Synthetic oligonucleotide
cattatatagttcgaccgttcgagt

SEQ ID NO: 729107 - DNA, 25 bp, Artificial sequence
  Synthetic oligonucleotide
ttctgttcgcgatcaatcatacgat

SEQ ID NO: 729108 - DNA, 25 bp, Artificial sequence
  Synthetic oligonucleotide
ttctgttcgcgaacaatcatacgat

SEQ ID NO: 729109 - DNA, 25 bp, Artificial sequence
  Synthetic oligonucleotide
actttagtatcgtctagcgtagtac

SEQ ID NO: 729110 - DNA, 25 bp, Artificial sequence
  Synthetic oligonucleotide
actttagtatcgactagcgtagtac

SEQ ID NO: 729111 - DNA, 25 bp, Artificial sequence
  Synthetic oligonucleotide
ttagtagatagtcgctacgtgatgt

SEQ ID NO: 729112 - DNA, 25 bp, Artificial sequence
  Synthetic oligonucleotide
aaaagagttagtcgtcgcagatcta

SEQ ID NO: 729113 - DNA, 25 bp, Artificial sequence
  Synthetic oligonucleotide
attatctagtattccgcgagtatgc

SEQ ID NO: 729114 - DNA, 25 bp, Artificial sequence
  Synthetic oligonucleotide
accaccatagatggtcgcaatttaa

SEQ ID NO: 729115 - DNA, 25 bp, Artificial sequence
  Synthetic oligonucleotide
catacttacgattagcgcgagaata

SEQ ID NO: 729116 - DNA, 25 bp, Artificial sequence
  Synthetic oligonucleotide
agtaaagcgttattgcgaacttcct

SEQ ID NO: 729117 - DNA, 25 bp, Artificial sequence
  Synthetic oligonucleotide
agtaaagcgttaatgcgaacttcct

SEQ ID NO: 729118 - DNA, 25 bp, Artificial sequence
  Synthetic oligonucleotide
atctacatgcgacgcagtacaatta

SEQ ID NO: 729119 - DNA, 25 bp, Artificial sequence
  Synthetic oligonucleotide
atctacatgcgaggcagtacaatta

SEQ ID NO: 729120 - DNA, 25 bp, Artificial sequence
  Synthetic oligonucleotide
gatattcagtataacgcgcgtgttt

SEQ ID NO: 729121 - DNA, 25 bp, Artificial sequence
  Synthetic oligonucleotide
tattacacggttccgcgttatgata

SEQ ID NO: 729122 - DNA, 25 bp, Artificial sequence
  Synthetic oligonucleotide
ctgaaatcgcgcacgattaaaaatg

SEQ ID NO: 729123 - DNA, 25 bp, Artificial sequence
  Synthetic oligonucleotide
cattatatagttggaccgttcgagt

SEQ ID NO: 729124 - DNA, 25 bp, Artificial sequence
  Synthetic oligonucleotide
aaatcttctatcggctacgtcaatc

SEQ ID NO: 729125 - DNA, 25 bp, Artificial sequence
  Synthetic oligonucleotide
aaatcttctatccgctacgtcaatc

SEQ ID NO: 729126 - DNA, 25 bp, Artificial sequence
  Synthetic oligonucleotide
ttagttactcgcgacgtattaactc

SEQ ID NO: 729127 - DNA, 25 bp, Artificial sequence
  Synthetic oligonucleotide
ttagttactcgccacgtattaactc

SEQ ID NO: 729128 - DNA, 25 bp, Artificial sequence
  Synthetic oligonucleotide
tgttacgatgcgggattaacatcta

SEQ ID NO: 729129 - DNA, 25 bp, Artificial sequence
  Synthetic oligonucleotide
tgttacgatgcgcgattaacatcta

SEQ ID NO: 729130 - DNA, 25 bp, Artificial sequence
  Synthetic oligonucleotide
gtcttatagtcacgattcgactaga

SEQ ID NO: 729131 - DNA, 25 bp, Artificial sequence
  Synthetic oligonucleotide
gatattcagtattacgcgcgtgttt

SEQ ID NO: 729132 - DNA, 25 bp, Artificial sequence
  Synthetic oligonucleotide
taattgtatcgacaacgcgtagtag

SEQ ID NO: 729133 - DNA, 25 bp, Artificial sequence
  Synthetic oligonucleotide
ttttctcgcgcaatacgtatttggt

SEQ ID NO: 729134 - DNA, 25 bp, Artificial sequence
  Synthetic oligonucleotide
ttttctcgcgcattacgtatttggt

SEQ ID NO: 729135 - DNA, 25 bp, Artificial sequence
  Synthetic oligonucleotide
aaactagtaacgccgatacctgtat

SEQ ID NO: 729136 - DNA, 25 bp, Artificial sequence
  Synthetic oligonucleotide
cgatttcatcgttatacgactagga

SEQ ID NO: 729137 - DNA, 25 bp, Artificial sequence
  Synthetic oligonucleotide
acttaccagctattacgcgaactaa

SEQ ID NO: 729138 - DNA, 25 bp, Artificial sequence
  Synthetic oligonucleotide
acttaccagctaatacgcgaactaa

SEQ ID NO: 729139 - DNA, 25 bp, Artificial sequence
  Synthetic oligonucleotide
tgaaaatgcgatgcggttaatgcat

SEQ ID NO: 729140 - DNA, 25 bp, Artificial sequence
  Synthetic oligonucleotide
tgaaaatgcgatccggttaatgcat

SEQ ID NO: 729141 - DNA, 25 bp, Artificial sequence
  Synthetic oligonucleotide
atcacttcggtccacaagaatagta

SEQ ID NO: 729142 - DNA, 25 bp, Artificial sequence
  Synthetic oligonucleotide
taattgtatcgagaacgcgtagtag

SEQ ID NO: 729143 - DNA, 25 bp, Artificial sequence
  Synthetic oligonucleotide
aaactagtaacggcgatacctgtat

SEQ ID NO: 729144 - DNA, 25 bp, Artificial sequence
  Synthetic oligonucleotide
tttatgatcccggaacgatgataag

SEQ ID NO: 729145 - DNA, 25 bp, Artificial sequence
  Synthetic oligonucleotide
tttatgatcccgcaacgatgataag

SEQ ID NO: 729146 - DNA, 25 bp, Artificial sequence
  Synthetic oligonucleotide
aaaatttatcggtctcacgtacagc

SEQ ID NO: 729147 - DNA, 25 bp, Artificial sequence
  Synthetic oligonucleotide
aaaatttatcggactcacgtacagc

SEQ ID NO: 729148 - DNA, 25 bp, Artificial sequence
  Synthetic oligonucleotide
taactgcgcgtcaagtagttaatca

SEQ ID NO: 729149 - DNA, 25 bp, Artificial sequence
  Synthetic oligonucleotide
atcacttcggtcgacaagaatagta

SEQ ID NO: 729150 - DNA, 25 bp, Artificial sequence
  Synthetic oligonucleotide
aagaacgcgataggacgtattatac

SEQ ID NO: 729151 - DNA, 25 bp, Artificial sequence
  Synthetic oligonucleotide
tactaatagttcctacgacattcgc

SEQ ID NO: 729152 - DNA, 25 bp, Artificial sequence
  Synthetic oligonucleotide
ttgttgattccttcgcgtaaacagt

SEQ ID NO: 729153 - DNA, 25 bp, Artificial sequence
  Synthetic oligonucleotide
ttgttgattcctacgcgtaaacagt

SEQ ID NO: 729154 - DNA, 25 bp, Artificial sequence
  Synthetic oligonucleotide
atctagtaagttggcgtacttcgaa

SEQ ID NO: 729155 - DNA, 25 bp, Artificial sequence
  Synthetic oligonucleotide
aatagtcttaccccacgattagctt

SEQ ID NO: 729156 - DNA, 25 bp, Artificial sequence
  Synthetic oligonucleotide
atctagtaagttcgcgtacttcgaa

SEQ ID NO: 729157 - DNA, 25 bp, Artificial sequence
  Synthetic oligonucleotide
aatagtcttaccgcacgattagctt

SEQ ID NO: 729158 - DNA, 25 bp, Artificial sequence
  Synthetic oligonucleotide
atctgaatcgtattggacgtgtcta

SEQ ID NO: 729159 - DNA, 25 bp, Artificial sequence
  Synthetic oligonucleotide
aagaacgcgatacgacgtattatac

SEQ ID NO: 729160 - DNA, 25 bp, Artificial sequence
  Synthetic oligonucleotide
ctgataaagttagggctcgtaatgt

SEQ ID NO: 729161 - DNA, 25 bp, Artificial sequence
  Synthetic oligonucleotide
ctgataaagttacggctcgtaatgt

SEQ ID NO: 729162 - DNA, 25 bp, Artificial sequence
  Synthetic oligonucleotide
taactgcgcgtctagtagttaatca

SEQ ID NO: 729163 - DNA, 25 bp, Artificial sequence
  Synthetic oligonucleotide
aactcatatggtgcgacgattacat

SEQ ID NO: 729164 - DNA, 25 bp, Artificial sequence
  Synthetic oligonucleotide
cgatttcatcgtaatacgactagga

SEQ ID NO: 729165 - DNA, 25 bp, Artificial sequence
  Synthetic oligonucleotide
aactcatatggtccgacgattacat

SEQ ID NO: 729166 - DNA, 25 bp, Artificial sequence
  Synthetic oligonucleotide
tcatataatccggcgtattggaact

SEQ ID NO: 729167 - DNA, 25 bp, Artificial sequence
  Synthetic oligonucleotide
aatgtctagcgaacgcgtatttttc

SEQ ID NO: 729168 - DNA, 25 bp, Artificial sequence
  Synthetic oligonucleotide
aatgtctagcgatcgcgtatttttc

SEQ ID NO: 729169 - DNA, 25 bp, Artificial sequence
  Synthetic oligonucleotide
ggtcactagtatggtgcgttaatat

SEQ ID NO: 729170 - DNA, 25 bp, Artificial sequence
  Synthetic oligonucleotide
ggtcactagtatcgtgcgttaatat

SEQ ID NO: 729171 - DNA, 25 bp, Artificial sequence
  Synthetic oligonucleotide
taatggcgatccgttatagtctaag

SEQ ID NO: 729172 - DNA, 25 bp, Artificial sequence
  Synthetic oligonucleotide
tcatataatccgccgtattggaact

SEQ ID NO: 729173 - DNA, 25 bp, Artificial sequence
  Synthetic oligonucleotide
tactaatagttcgtacgacattcgc

SEQ ID NO: 729174 - DNA, 25 bp, Artificial sequence
  Synthetic oligonucleotide
ttcacacgtaacccgttaactctaa

SEQ ID NO: 729175 - DNA, 25 bp, Artificial sequence
  Synthetic oligonucleotide
atctgaatcgtaatggacgtgtcta

SEQ ID NO: 729176 - DNA, 25 bp, Artificial sequence
  Synthetic oligonucleotide
ttcacacgtaacgcgttaactctaa

SEQ ID NO: 729177 - DNA, 25 bp, Artificial sequence
  Synthetic oligonucleotide
agtttgtacgcgttactacattcga

SEQ ID NO: 729178 - DNA, 25 bp, Artificial sequence
  Synthetic oligonucleotide
agtttgtacgcgatactacattcga

SEQ ID NO: 729179 - DNA, 25 bp, Artificial sequence
  Synthetic oligonucleotide
aattgaccgcgagtagtactattca

SEQ ID NO: 729180 - DNA, 25 bp, Artificial sequence
  Synthetic oligonucleotide
aattgaccgcgactagtactattca

SEQ ID NO: 729181 - DNA, 25 bp, Artificial sequence
  Synthetic oligonucleotide
taatggcgatcccttatagtctaag

SEQ ID NO: 729182 - DNA, 25 bp, Artificial sequence
  Synthetic oligonucleotide
accagactcgcatttcgtagttagt

SEQ ID NO: 729183 - DNA, 25 bp, Artificial sequence
  Synthetic oligonucleotide
ttatatgtcgcgaccttatccgact

SEQ ID NO: 729184 - DNA, 25 bp, Artificial sequence
  Synthetic oligonucleotide
ttatatgtcgcgtccttatccgact

SEQ ID NO: 729185 - DNA, 25 bp, Artificial sequence
  Synthetic oligonucleotide
ttcaatgtacgtttcgacgatgggt

SEQ ID NO: 729186 - DNA, 25 bp, Artificial sequence
  Synthetic oligonucleotide
ttcaatgtacgtatcgacgatgggt

SEQ ID NO: 729187 - DNA, 25 bp, Artificial sequence
  Synthetic oligonucleotide
acactttcgtttacgccgatactct

SEQ ID NO: 729188 - DNA, 25 bp, Artificial sequence
  Synthetic oligonucleotide
accagactcgcaattcgtagttagt

SEQ ID NO: 729189 - DNA, 25 bp, Artificial sequence
  Synthetic oligonucleotide
atttgcttatcgccgtcgtactcat

SEQ ID NO: 729190 - DNA, 25 bp, Artificial sequence
  Synthetic oligonucleotide
atttgcttatcggcgtcgtactcat

SEQ ID NO: 729191 - DNA, 25 bp, Artificial sequence
  Synthetic oligonucleotide
cctgaactatcccctacgatatgaa

SEQ ID NO: 729192 - DNA, 25 bp, Artificial sequence
  Synthetic oligonucleotide
cctgaactatccgctacgatatgaa

SEQ ID NO: 729193 - DNA, 25 bp, Artificial sequence
  Synthetic oligonucleotide
acactttcgttttcgccgatactct

SEQ ID NO: 729194 - DNA, 25 bp, Artificial sequence
  Synthetic oligonucleotide
ataaaggcgttaaacgtgcgaatgg

SEQ ID NO: 729195 - DNA, 25 bp, Artificial sequence
  Synthetic oligonucleotide
accgttcgtatgattcggaaaatgg

SEQ ID NO: 729196 - DNA, 25 bp, Artificial sequence
  Synthetic oligonucleotide
gcattcatgacttacgcgacatagt

SEQ ID NO: 729197 - DNA, 25 bp, Artificial sequence
  Synthetic oligonucleotide
aagtttcgcattcgtcgtaaacgga

SEQ ID NO: 729198 - DNA, 25 bp, Artificial sequence
  Synthetic oligonucleotide
gcattcatgactaacgcgacatagt

SEQ ID NO: 729199 - DNA, 25 bp, Artificial sequence
  Synthetic oligonucleotide
atcaagtaataggggatcggtacct

SEQ ID NO: 729200 - DNA, 25 bp, Artificial sequence
  Synthetic oligonucleotide
catcacatcgaaggtacggttagaa

SEQ ID NO: 729201 - DNA, 25 bp, Artificial sequence
  Synthetic oligonucleotide
ataaaggcgttatacgtgcgaatgg

SEQ ID NO: 729202 - DNA, 25 bp, Artificial sequence
  Synthetic oligonucleotide
catcacatcgaacgtacggttagaa

SEQ ID NO: 729203 - DNA, 25 bp, Artificial sequence
  Synthetic oligonucleotide
tcactacctacgggacttatctaac

SEQ ID NO: 729204 - DNA, 25 bp, Artificial sequence
  Synthetic oligonucleotide
tcactacctacgcgacttatctaac

SEQ ID NO: 729205 - DNA, 25 bp, Artificial sequence
  Synthetic oligonucleotide
cttacatcgtatcgtaccggttttc

SEQ ID NO: 729206 - DNA, 25 bp, Artificial sequence
  Synthetic oligonucleotide
cttacatcgtatggtaccggttttc

SEQ ID NO: 729207 - DNA, 25 bp, Artificial sequence
  Synthetic oligonucleotide
ttagatattctgacgcgtagtgagc

SEQ ID NO: 729208 - DNA, 25 bp, Artificial sequence
  Synthetic oligonucleotide
ttagatattctgtcgcgtagtgagc

SEQ ID NO: 729209 - DNA, 25 bp, Artificial sequence
  Synthetic oligonucleotide
atcaagtaatagcggatcggtacct

SEQ ID NO: 729210 - DNA, 25 bp, Artificial sequence
  Synthetic oligonucleotide
acctatagtcgtaaccgcgcatata

SEQ ID NO: 729211 - DNA, 25 bp, Artificial sequence
  Synthetic oligonucleotide
ccaattgttcgcgatagtaatggtc

SEQ ID NO: 729212 - DNA, 25 bp, Artificial sequence
  Synthetic oligonucleotide
accaattcgactatggacggatttc

SEQ ID NO: 729213 - DNA, 25 bp, Artificial sequence
  Synthetic oligonucleotide
accaattcgactttggacggatttc

SEQ ID NO: 729214 - DNA, 25 bp, Artificial sequence
  Synthetic oligonucleotide
acaaaaggccgatagatcgttcagt

SEQ ID NO: 729215 - DNA, 25 bp, Artificial sequence
  Synthetic oligonucleotide
accgttcgtatgtttcggaaaatgg

SEQ ID NO: 729216 - DNA, 25 bp, Artificial sequence
  Synthetic oligonucleotide
cgcatagttcgcgaacgttctaaaa

SEQ ID NO: 729217 - DNA, 25 bp, Artificial sequence
  Synthetic oligonucleotide
aactatcgatacccggaattcacac

SEQ ID NO: 729218 - DNA, 25 bp, Artificial sequence
  Synthetic oligonucleotide
ctcgtgcgacgttacgtctaattta

SEQ ID NO: 729219 - DNA, 25 bp, Artificial sequence
  Synthetic oligonucleotide
ctcgtgcgacgtaacgtctaattta

SEQ ID NO: 729220 - DNA, 25 bp, Artificial sequence
  Synthetic oligonucleotide
ctgattactagtggcgcttgagtta

SEQ ID NO: 729221 - DNA, 25 bp, Artificial sequence
  Synthetic oligonucleotide
ctgattactagtcgcgcttgagtta

SEQ ID NO: 729222 - DNA, 25 bp, Artificial sequence
  Synthetic oligonucleotide
gaacttcgaatagcgtcgtagtgtt

SEQ ID NO: 729223 - DNA, 25 bp, Artificial sequence
  Synthetic oligonucleotide
aactatcgatacgcggaattcacac

SEQ ID NO: 729224 - DNA, 25 bp, Artificial sequence
  Synthetic oligonucleotide
acctatagtcgttaccgcgcatata

SEQ ID NO: 729225 - DNA, 25 bp, Artificial sequence
  Synthetic oligonucleotide
aagtttcgcattggtcgtaaacgga

SEQ ID NO: 729226 - DNA, 25 bp, Artificial sequence
  Synthetic oligonucleotide
ggattattcgtacgatacggtttcg

SEQ ID NO: 729227 - DNA, 25 bp, Artificial sequence
  Synthetic oligonucleotide
ggattattcgtaggatacggtttcg

SEQ ID NO: 729228 - DNA, 25 bp, Artificial sequence
  Synthetic oligonucleotide
tactatgacgtcccgtatatctacg

SEQ ID NO: 729229 - DNA, 25 bp, Artificial sequence
  Synthetic oligonucleotide
tactatgacgtcgcgtatatctacg

SEQ ID NO: 729230 - DNA, 25 bp, Artificial sequence
  Synthetic oligonucleotide
caatcacgtacgcgtagaaccattt

SEQ ID NO: 729231 - DNA, 25 bp, Artificial sequence
  Synthetic oligonucleotide
caatcacgtacgggtagaaccattt

SEQ ID NO: 729232 - DNA, 25 bp, Artificial sequence
  Synthetic oligonucleotide
tgaagttacgcgttaaaccatcagc

SEQ ID NO: 729233 - DNA, 25 bp, Artificial sequence
  Synthetic oligonucleotide
tgaagttacgcgataaaccatcagc

SEQ ID NO: 729234 - DNA, 25 bp, Artificial sequence
  Synthetic oligonucleotide
ctaaatcgataagggtcggtaatcg

SEQ ID NO: 729235 - DNA, 25 bp, Artificial sequence
  Synthetic oligonucleotide
agacaacgagcgtacaacggaattt

SEQ ID NO: 729236 - DNA, 25 bp, Artificial sequence
  Synthetic oligonucleotide
atctcatcgcgcaacactaatcagt

SEQ ID NO: 729237 - DNA, 25 bp, Artificial sequence
  Synthetic oligonucleotide
atctcatcgcgctacactaatcagt

SEQ ID NO: 729238 - DNA, 25 bp, Artificial sequence
  Synthetic oligonucleotide
gaacttcgaataccgtcgtagtgtt

SEQ ID NO: 729239 - DNA, 25 bp, Artificial sequence
  Synthetic oligonucleotide
gtgtaatcggcaaacgaagtaactc

SEQ ID NO: 729240 - DNA, 25 bp, Artificial sequence
  Synthetic oligonucleotide
caagatccgcgtaatacgacgtaat

SEQ ID NO: 729241 - DNA, 25 bp, Artificial sequence
  Synthetic oligonucleotide
tatggccgccgtactagtaatttga

SEQ ID NO: 729242 - DNA, 25 bp, Artificial sequence
  Synthetic oligonucleotide
caaagtgtaggaggccgtatcttaa

SEQ ID NO: 729243 - DNA, 25 bp, Artificial sequence
  Synthetic oligonucleotide
caaagtgtaggacgccgtatcttaa

SEQ ID NO: 729244 - DNA, 25 bp, Artificial sequence
  Synthetic oligonucleotide
cctattcgcgaatgtaccaacctta

SEQ ID NO: 729245 - DNA, 25 bp, Artificial sequence
  Synthetic oligonucleotide
cctattcgcgaaagtaccaacctta

SEQ ID NO: 729246 - DNA, 25 bp, Artificial sequence
  Synthetic oligonucleotide
ctttcaggtttatcgcgacgaattc

SEQ ID NO: 729247 - DNA, 25 bp, Artificial sequence
  Synthetic oligonucleotide
gatcacacgctacaccgatttctat

SEQ ID NO: 729248 - DNA, 25 bp, Artificial sequence
  Synthetic oligonucleotide
ctttcaggtttaacgcgacgaattc

SEQ ID NO: 729249 - DNA, 25 bp, Artificial sequence
  Synthetic oligonucleotide
gtgtaatcggcatacgaagtaactc

SEQ ID NO: 729250 - DNA, 25 bp, Artificial sequence
  Synthetic oligonucleotide
tttaccattagtgcgacgccgtaat

SEQ ID NO: 729251 - DNA, 25 bp, Artificial sequence
  Synthetic oligonucleotide
tttaccattagtccgacgccgtaat

SEQ ID NO: 729252 - DNA, 25 bp, Artificial sequence
  Synthetic oligonucleotide
tctaacctcatatctcgcgatatgc

SEQ ID NO: 729253 - DNA, 25 bp, Artificial sequence
  Synthetic oligonucleotide
tctaacctcataactcgcgatatgc

SEQ ID NO: 729254 - DNA, 25 bp, Artificial sequence
  Synthetic oligonucleotide
atcaacacgcgatacaatgatctgc

SEQ ID NO: 729255 - DNA, 25 bp, Artificial sequence
  Synthetic oligonucleotide
gtcaaacgcgacgatataaacgatg

SEQ ID NO: 729256 - DNA, 25 bp, Artificial sequence
  Synthetic oligonucleotide
gatcacacgctagaccgatttctat

SEQ ID NO: 729257 - DNA, 25 bp, Artificial sequence
  Synthetic oligonucleotide
gtttctcgcccgatagtatctgttt

SEQ ID NO: 729258 - DNA, 25 bp, Artificial sequence
  Synthetic oligonucleotide
ctaaatcgataacggtcggtaatcg

SEQ ID NO: 729259 - DNA, 25 bp, Artificial sequence
  Synthetic oligonucleotide
ccaattgttcgccatagtaatggtc

SEQ ID NO: 729260 - DNA, 25 bp, Artificial sequence
  Synthetic oligonucleotide
gatcttaacgcgacgttagttaagc

SEQ ID NO: 729261 - DNA, 25 bp, Artificial sequence
  Synthetic oligonucleotide
gatcttaacgcgtcgttagttaagc

SEQ ID NO: 729262 - DNA, 25 bp, Artificial sequence
  Synthetic oligonucleotide
gaataagcgtcacacgtatgagatg

SEQ ID NO: 729263 - DNA, 25 bp, Artificial sequence
  Synthetic oligonucleotide
gaataagcgtcagacgtatgagatg

SEQ ID NO: 729264 - DNA, 25 bp, Artificial sequence
  Synthetic oligonucleotide
tatggccgccgttctagtaatttga

SEQ ID NO: 729265 - DNA, 25 bp, Artificial sequence
  Synthetic oligonucleotide
tgtattgtcgcgtacgaatgcatac

SEQ ID NO: 729266 - DNA, 25 bp, Artificial sequence
  Synthetic oligonucleotide
caagatccgcgttatacgacgtaat

SEQ ID NO: 729267 - DNA, 25 bp, Artificial sequence
  Synthetic oligonucleotide
gtttctcgcccgttagtatctgttt

SEQ ID NO: 729268 - DNA, 25 bp, Artificial sequence
  Synthetic oligonucleotide
aatactaacgctatcggacccatac

SEQ ID NO: 729269 - DNA, 25 bp, Artificial sequence
  Synthetic oligonucleotide
aatactaacgctttcggacccatac

SEQ ID NO: 729270 - DNA, 25 bp, Artificial sequence
  Synthetic oligonucleotide
tacttaccgattaggcgaactcaca

SEQ ID NO: 729271 - DNA, 25 bp, Artificial sequence
  Synthetic oligonucleotide
tacttaccgatttggcgaactcaca

SEQ ID NO: 729272 - DNA, 25 bp, Artificial sequence
  Synthetic oligonucleotide
ttctctactaatacgcggatgcact

SEQ ID NO: 729273 - DNA, 25 bp, Artificial sequence
  Synthetic oligonucleotide
ttctctactaattcgcggatgcact

SEQ ID NO: 729274 - DNA, 25 bp, Artificial sequence
  Synthetic oligonucleotide
tgtattgtcgcgaacgaatgcatac

SEQ ID NO: 729275 - DNA, 25 bp, Artificial sequence
  Synthetic oligonucleotide
cgtgaagacagtacgcgtaaatgta

SEQ ID NO: 729276 - DNA, 25 bp, Artificial sequence
  Synthetic oligonucleotide
atcaacacgcgaaacaatgatctgc

SEQ ID NO: 729277 - DNA, 25 bp, Artificial sequence
  Synthetic oligonucleotide
tggactctacgcagatcgtaaattg

SEQ ID NO: 729278 - DNA, 25 bp, Artificial sequence
  Synthetic oligonucleotide
cgtaaatagtatcgcggtatccatg

SEQ ID NO: 729279 - DNA, 25 bp, Artificial sequence
  Synthetic oligonucleotide
cgtaaatagtatggcggtatccatg

SEQ ID NO: 729280 - DNA, 25 bp, Artificial sequence
  Synthetic oligonucleotide
aactagcgttagtactcgacattcg

SEQ ID NO: 729281 - DNA, 25 bp, Artificial sequence
  Synthetic oligonucleotide
aactagcgttagaactcgacattcg

SEQ ID NO: 729282 - DNA, 25 bp, Artificial sequence
  Synthetic oligonucleotide
gcctgtactattcgacgcattatac

SEQ ID NO: 729283 - DNA, 25 bp, Artificial sequence
  Synthetic oligonucleotide
tactcatacgttatgacgcgacctt

SEQ ID NO: 729284 - DNA, 25 bp, Artificial sequence
  Synthetic oligonucleotide
gcctgtactattggacgcattatac

SEQ ID NO: 729285 - DNA, 25 bp, Artificial sequence
  Synthetic oligonucleotide
cgtgaagacagttcgcgtaaatgta

SEQ ID NO: 729286 - DNA, 25 bp, Artificial sequence
  Synthetic oligonucleotide
actttacgcgatgtacgatcgtttc

SEQ ID NO: 729287 - DNA, 25 bp, Artificial sequence
  Synthetic oligonucleotide
actttacgcgatctacgatcgtttc

SEQ ID NO: 729288 - DNA, 25 bp, Artificial sequence
  Synthetic oligonucleotide
cttgtttacgccgaccttaaacaga

SEQ ID NO: 729289 - DNA, 25 bp, Artificial sequence
  Synthetic oligonucleotide
cttgtttacgcccaccttaaacaga

SEQ ID NO: 729290 - DNA, 25 bp, Artificial sequence
  Synthetic oligonucleotide
tgcgcatcactaattcgcggttttt

SEQ ID NO: 729291 - DNA, 25 bp, Artificial sequence
  Synthetic oligonucleotide
tgcgcatcactatttcgcggttttt

SEQ ID NO: 729292 - DNA, 25 bp, Artificial sequence
  Synthetic oligonucleotide
tactcatacgttttgacgcgacctt

SEQ ID NO: 729293 - DNA, 25 bp, Artificial sequence
  Synthetic oligonucleotide
agtagcgtctaaggacgtattgcat

SEQ ID NO: 729294 - DNA, 25 bp, Artificial sequence
  Synthetic oligonucleotide
ttcctccgtacgctatctataactc

SEQ ID NO: 729295 - DNA, 25 bp, Artificial sequence
  Synthetic oligonucleotide
ttcctccgtacggtatctataactc

SEQ ID NO: 729296 - DNA, 25 bp, Artificial sequence
  Synthetic oligonucleotide
acaaaaggccgaaagatcgttcagt

SEQ ID NO: 729297 - DNA, 25 bp, Artificial sequence
  Synthetic oligonucleotide
gtcaaacgcgaccatataaacgatg

SEQ ID NO: 729298 - DNA, 25 bp, Artificial sequence
  Synthetic oligonucleotide
tagtcagtagcgtcgtatgtgtaac

SEQ ID NO: 729299 - DNA, 25 bp, Artificial sequence
  Synthetic oligonucleotide
tagtcagtagcgacgtatgtgtaac

SEQ ID NO: 729300 - DNA, 25 bp, Artificial sequence
  Synthetic oligonucleotide
tggactctacgctgatcgtaaattg

SEQ ID NO: 729301 - DNA, 25 bp, Artificial sequence
  Synthetic oligonucleotide
atcatcgattctagcgcgaactcta

SEQ ID NO: 729302 - DNA, 25 bp, Artificial sequence
  Synthetic oligonucleotide
cgcatagttcgccaacgttctaaaa

SEQ ID NO: 729303 - DNA, 25 bp, Artificial sequence
  Synthetic oligonucleotide
agtagcgtctaacgacgtattgcat

SEQ ID NO: 729304 - DNA, 25 bp, Artificial sequence
  Synthetic oligonucleotide
tataaacgaactagtgtcgcgagca

SEQ ID NO: 729305 - DNA, 25 bp, Artificial sequence
  Synthetic oligonucleotide
tataaacgaacttgtgtcgcgagca

SEQ ID NO: 729306 - DNA, 25 bp, Artificial sequence
  Synthetic oligonucleotide
tgaccttaccgttgcgaataaacgt

SEQ ID NO: 729307 - DNA, 25 bp, Artificial sequence
  Synthetic oligonucleotide
tgaccttaccgtagcgaataaacgt

SEQ ID NO: 729308 - DNA, 25 bp, Artificial sequence
  Synthetic oligonucleotide
tactactacctccacgtaaggtaga

SEQ ID NO: 729309 - DNA, 25 bp, Artificial sequence
  Synthetic oligonucleotide
tactactacctcgacgtaaggtaga

SEQ ID NO: 729310 - DNA, 25 bp, Artificial sequence
  Synthetic oligonucleotide
atcatcgattcttgcgcgaactcta

SEQ ID NO: 729311 - DNA, 25 bp, Artificial sequence
  Synthetic oligonucleotide
tgattccctaacccgagtagaaatg

SEQ ID NO: 729312 - DNA, 25 bp, Artificial sequence
  Synthetic oligonucleotide
gcatataccggcgttatatatgctg

SEQ ID NO: 729313 - DNA, 25 bp, Artificial sequence
  Synthetic oligonucleotide
agtcatatacgcggccctatgtaaa

SEQ ID NO: 729314 - DNA, 25 bp, Artificial sequence
  Synthetic oligonucleotide
agtcatatacgccgccctatgtaaa

SEQ ID NO: 729315 - DNA, 25 bp, Artificial sequence
  Synthetic oligonucleotide
gatacttacgcccatagactcaaca

SEQ ID NO: 729316 - DNA, 25 bp, Artificial sequence
  Synthetic oligonucleotide
gatacttacgccgatagactcaaca

SEQ ID NO: 729317 - DNA, 25 bp, Artificial sequence
  Synthetic oligonucleotide
tagattattggcctcgtactagcac

SEQ ID NO: 729318 - DNA, 25 bp, Artificial sequence
  Synthetic oligonucleotide
ccggttgcgtaatatgtcgattatc

SEQ ID NO: 729319 - DNA, 25 bp, Artificial sequence
  Synthetic oligonucleotide
tgattccctaacgcgagtagaaatg

SEQ ID NO: 729320 - DNA, 25 bp, Artificial sequence
  Synthetic oligonucleotide
aatctgcgctacgattaactgacgt

SEQ ID NO: 729321 - DNA, 25 bp, Artificial sequence
  Synthetic oligonucleotide
catagtagtacgacgctagggttta

SEQ ID NO: 729322 - DNA, 25 bp, Artificial sequence
  Synthetic oligonucleotide
catagtagtacgtcgctagggttta

SEQ ID NO: 729323 - DNA, 25 bp, Artificial sequence
  Synthetic oligonucleotide
ctttgatcggacctagacgttatac

SEQ ID NO: 729324 - DNA, 25 bp, Artificial sequence
  Synthetic oligonucleotide
ctttgatcggacgtagacgttatac

SEQ ID NO: 729325 - DNA, 25 bp, Artificial sequence
  Synthetic oligonucleotide
ctttatggttacgttatcggtgagc

SEQ ID NO: 729326 - DNA, 25 bp, Artificial sequence
  Synthetic oligonucleotide
tgcacttaaggtggatcggaatatg

SEQ ID NO: 729327 - DNA, 25 bp, Artificial sequence
  Synthetic oligonucleotide
tagattattggcgtcgtactagcac

SEQ ID NO: 729328 - DNA, 25 bp, Artificial sequence
  Synthetic oligonucleotide
ttcaaccggtcgaaagctttaatcc

SEQ ID NO: 729329 - DNA, 25 bp, Artificial sequence
  Synthetic oligonucleotide
aataccatcaccgtacgggctttat

SEQ ID NO: 729330 - DNA, 25 bp, Artificial sequence
  Synthetic oligonucleotide
aaagattagacgcgtaatcggcatg

SEQ ID NO: 729331 - DNA, 25 bp, Artificial sequence
  Synthetic oligonucleotide
aatctcatatggcgtcccgagattt

SEQ ID NO: 729332 - DNA, 25 bp, Artificial sequence
  Synthetic oligonucleotide
aatctcatatggggtcccgagattt

SEQ ID NO: 729333 - DNA, 25 bp, Artificial sequence
  Synthetic oligonucleotide
tgaatacgacgcctattatggcatc

SEQ ID NO: 729334 - DNA, 25 bp, Artificial sequence
  Synthetic oligonucleotide
tgaatacgacgcgtattatggcatc

SEQ ID NO: 729335 - DNA, 25 bp, Artificial sequence
  Synthetic oligonucleotide
ccggttgcgtaaaatgtcgattatc

SEQ ID NO: 729336 - DNA, 25 bp, Artificial sequence
  Synthetic oligonucleotide
ggctagcgaattagtagcgatagta

SEQ ID NO: 729337 - DNA, 25 bp, Artificial sequence
  Synthetic oligonucleotide
gcatataccggccttatatatgctg

SEQ ID NO: 729338 - DNA, 25 bp, Artificial sequence
  Synthetic oligonucleotide
ttcaaccggtcgtaagctttaatcc

SEQ ID NO: 729339 - DNA, 25 bp, Artificial sequence
  Synthetic oligonucleotide
atctacgatcgcgcactaagaatca

SEQ ID NO: 729340 - DNA, 25 bp, Artificial sequence
  Synthetic oligonucleotide
atctacgatcgcccactaagaatca

SEQ ID NO: 729341 - DNA, 25 bp, Artificial sequence
  Synthetic oligonucleotide
aaaggccgtcgactagtaatgtaac

SEQ ID NO: 729342 - DNA, 25 bp, Artificial sequence
  Synthetic oligonucleotide
aaaggccgtcgagtagtaatgtaac

SEQ ID NO: 729343 - DNA, 25 bp, Artificial sequence
  Synthetic oligonucleotide
aatctgcgctaccattaactgacgt

SEQ ID NO: 729344 - DNA, 25 bp, Artificial sequence
  Synthetic oligonucleotide
ggctagcgaatttgtagcgatagta

SEQ ID NO: 729345 - DNA, 25 bp, Artificial sequence
  Synthetic oligonucleotide
tttggtctcgcgaacgatatgaaac

SEQ ID NO: 729346 - DNA, 25 bp, Artificial sequence
  Synthetic oligonucleotide
ctttatggttaccttatcggtgagc

SEQ ID NO: 729347 - DNA, 25 bp, Artificial sequence
  Synthetic oligonucleotide
agttacttccgatacgctacgtctt

SEQ ID NO: 729348 - DNA, 25 bp, Artificial sequence
  Synthetic oligonucleotide
agttacttccgaaacgctacgtctt

SEQ ID NO: 729349 - DNA, 25 bp, Artificial sequence
  Synthetic oligonucleotide
caaaaagcgtacgaactaggtcttg

SEQ ID NO: 729350 - DNA, 25 bp, Artificial sequence
  Synthetic oligonucleotide
caaaaagcgtaccaactaggtcttg

SEQ ID NO: 729351 - DNA, 25 bp, Artificial sequence
  Synthetic oligonucleotide
aatttagtattgccgtacccgatgg

SEQ ID NO: 729352 - DNA, 25 bp, Artificial sequence
  Synthetic oligonucleotide
tcagttctagcgcgatataaagcgt

SEQ ID NO: 729353 - DNA, 25 bp, Artificial sequence
  Synthetic oligonucleotide
tttggtctcgcgtacgatatgaaac

SEQ ID NO: 729354 - DNA, 25 bp, Artificial sequence
  Synthetic oligonucleotide
aacaactagaccctacgcgtacatt

SEQ ID NO: 729355 - DNA, 25 bp, Artificial sequence
  Synthetic oligonucleotide
gaacccatataatcgcgtccaatca

SEQ ID NO: 729356 - DNA, 25 bp, Artificial sequence
  Synthetic oligonucleotide
gaacccatataaacgcgtccaatca

SEQ ID NO: 729357 - DNA, 25 bp, Artificial sequence
  Synthetic oligonucleotide
cccttttacgcgtagtaattcgtca

SEQ ID NO: 729358 - DNA, 25 bp, Artificial sequence
  Synthetic oligonucleotide
cccttttacgcgaagtaattcgtca

SEQ ID NO: 729359 - DNA, 25 bp, Artificial sequence
  Synthetic oligonucleotide
tttccgcgcgtgatatagttggatt

SEQ ID NO: 729360 - DNA, 25 bp, Artificial sequence
  Synthetic oligonucleotide
tttccgcgcgtgttatagttggatt

SEQ ID NO: 729361 - DNA, 25 bp, Artificial sequence
  Synthetic oligonucleotide
aatttagtattggcgtacccgatgg

SEQ ID NO: 729362 - DNA, 25 bp, Artificial sequence
  Synthetic oligonucleotide
gcggaaacgtattgtcgcctattaa

SEQ ID NO: 729363 - DNA, 25 bp, Artificial sequence
  Synthetic oligonucleotide
tggtgacgataaggcgaatactttg

SEQ ID NO: 729364 - DNA, 25 bp, Artificial sequence
  Synthetic oligonucleotide
tggtgacgataacgcgaatactttg

SEQ ID NO: 729365 - DNA, 25 bp, Artificial sequence
  Synthetic oligonucleotide
agaatttccgcgatgatcggatttg

SEQ ID NO: 729366 - DNA, 25 bp, Artificial sequence
  Synthetic oligonucleotide
agaatttccgcgttgatcggatttg

SEQ ID NO: 729367 - DNA, 25 bp, Artificial sequence
  Synthetic oligonucleotide
caatttccccgaacgcgtttattca

SEQ ID NO: 729368 - DNA, 25 bp, Artificial sequence
  Synthetic oligonucleotide
caatttccccgatcgcgtttattca

SEQ ID NO: 729369 - DNA, 25 bp, Artificial sequence
  Synthetic oligonucleotide
tcagttctagcgggatataaagcgt

SEQ ID NO: 729370 - DNA, 25 bp, Artificial sequence
  Synthetic oligonucleotide
gctaattccgttttacgtgccagta

SEQ ID NO: 729371 - DNA, 25 bp, Artificial sequence
  Synthetic oligonucleotide
tgcacttaaggtcgatcggaatatg

SEQ ID NO: 729372 - DNA, 25 bp, Artificial sequence
  Synthetic oligonucleotide
gcggaaacgtatagtcgcctattaa

SEQ ID NO: 729373 - DNA, 25 bp, Artificial sequence
  Synthetic oligonucleotide
tatatatagggccgtatcgcgatga

SEQ ID NO: 729374 - DNA, 25 bp, Artificial sequence
  Synthetic oligonucleotide
tatatatagggcggtatcgcgatga

SEQ ID NO: 729375 - DNA, 25 bp, Artificial sequence
  Synthetic oligonucleotide
gaataaccgtgcgtaatagtgagag

SEQ ID NO: 729376 - DNA, 25 bp, Artificial sequence
  Synthetic oligonucleotide
gaataaccgtgcctaatagtgagag

SEQ ID NO: 729377 - DNA, 25 bp, Artificial sequence
  Synthetic oligonucleotide
aacaactagaccgtacgcgtacatt

SEQ ID NO: 729378 - DNA, 25 bp, Artificial sequence
  Synthetic oligonucleotide
gctaattccgttatacgtgccagta

SEQ ID NO: 729379 - DNA, 25 bp, Artificial sequence
  Synthetic oligonucleotide
caaggtaccgattgttccgtctaat

SEQ ID NO: 729380 - DNA, 25 bp, Artificial sequence
  Synthetic oligonucleotide
gatactaccgcggtattacatttgc

SEQ ID NO: 729381 - DNA, 25 bp, Artificial sequence
  Synthetic oligonucleotide
atacgctattcgaaccgacctagaa

SEQ ID NO: 729382 - DNA, 25 bp, Artificial sequence
  Synthetic oligonucleotide
atacgctattcgtaccgacctagaa

SEQ ID NO: 729383 - DNA, 25 bp, Artificial sequence
  Synthetic oligonucleotide
tcgttattgacggtcgatctacgat

SEQ ID NO: 729384 - DNA, 25 bp, Artificial sequence
  Synthetic oligonucleotide
tcgttattgacgctcgatctacgat

SEQ ID NO: 729385 - DNA, 25 bp, Artificial sequence
  Synthetic oligonucleotide
tgtaagatacggcgcttacgactta

SEQ ID NO: 729386 - DNA, 25 bp, Artificial sequence
  Synthetic oligonucleotide
ctaaactagcgtaccgatctgtgtt

SEQ ID NO: 729387 - DNA, 25 bp, Artificial sequence
  Synthetic oligonucleotide
caaggtaccgatagttccgtctaat

SEQ ID NO: 729388 - DNA, 25 bp, Artificial sequence
  Synthetic oligonucleotide
gacgtgcgcgtattatcgtatcatt

SEQ ID NO: 729389 - DNA, 25 bp, Artificial sequence
  Synthetic oligonucleotide
aacacttacgcgtctagtcgatatc

SEQ ID NO: 729390 - DNA, 25 bp, Artificial sequence
  Synthetic oligonucleotide
aacacttacgcgactagtcgatatc

SEQ ID NO: 729391 - DNA, 25 bp, Artificial sequence
  Synthetic oligonucleotide
ttctactactatcgcgctatctagg

SEQ ID NO: 729392 - DNA, 25 bp, Artificial sequence
  Synthetic oligonucleotide
ttctactactatggcgctatctagg

SEQ ID NO: 729393 - DNA, 25 bp, Artificial sequence
  Synthetic oligonucleotide
gtcttcatacgttcgacggtatgat

SEQ ID NO: 729394 - DNA, 25 bp, Artificial sequence
  Synthetic oligonucleotide
aaagattagacgggtaatcggcatg

SEQ ID NO: 729395 - DNA, 25 bp, Artificial sequence
  Synthetic oligonucleotide
tgtaagatacggggcttacgactta

SEQ ID NO: 729396 - DNA, 25 bp, Artificial sequence
  Synthetic oligonucleotide
ctattcgatctagcgtcgttacctt

SEQ ID NO: 729397 - DNA, 25 bp, Artificial sequence
  Synthetic oligonucleotide
aagagggcgctaggattgattcaaa

SEQ ID NO: 729398 - DNA, 25 bp, Artificial sequence
  Synthetic oligonucleotide
aagagggcgctacgattgattcaaa

SEQ ID NO: 729399 - DNA, 25 bp, Artificial sequence
  Synthetic oligonucleotide
tatcattcggacacgcgaataacct

SEQ ID NO: 729400 - DNA, 25 bp, Artificial sequence
  Synthetic oligonucleotide
tatcattcggactcgcgaataacct

SEQ ID NO: 729401 - DNA, 25 bp, Artificial sequence
  Synthetic oligonucleotide
cctagtgcgttcgacgtataataac

SEQ ID NO: 729402 - DNA, 25 bp, Artificial sequence
  Synthetic oligonucleotide
cctagtgcgttccacgtataataac

SEQ ID NO: 729403 - DNA, 25 bp, Artificial sequence
  Synthetic oligonucleotide
ctaaactagcgttccgatctgtgtt

SEQ ID NO: 729404 - DNA, 25 bp, Artificial sequence
  Synthetic oligonucleotide
actagtcgcatccgtaatattgctc

SEQ ID NO: 729405 - DNA, 25 bp, Artificial sequence
  Synthetic oligonucleotide
gatactaccgcgctattacatttgc

SEQ ID NO: 729406 - DNA, 25 bp, Artificial sequence
  Synthetic oligonucleotide
ctattcgatctaccgtcgttacctt

SEQ ID NO: 729407 - DNA, 25 bp, Artificial sequence
  Synthetic oligonucleotide
aaaggttcgatcggctattttggca

SEQ ID NO: 729408 - DNA, 25 bp, Artificial sequence
  Synthetic oligonucleotide
aaaggttcgatccgctattttggca

SEQ ID NO: 729409 - DNA, 25 bp, Artificial sequence
  Synthetic oligonucleotide
gctgttgtaacgatcggtctaaaac

SEQ ID NO: 729410 - DNA, 25 bp, Artificial sequence
  Synthetic oligonucleotide
gctgttgtaacgttcggtctaaaac

SEQ ID NO: 729411 - DNA, 25 bp, Artificial sequence
  Synthetic oligonucleotide
gacgtgcgcgtaatatcgtatcatt

SEQ ID NO: 729412 - DNA, 25 bp, Artificial sequence
  Synthetic oligonucleotide
actagtcgcatcggtaatattgctc

SEQ ID NO: 729413 - DNA, 25 bp, Artificial sequence
  Synthetic oligonucleotide
ataccatattgccggtgcgtaacaa

SEQ ID NO: 729414 - DNA, 25 bp, Artificial sequence
  Synthetic oligonucleotide
gtcttcatacgtacgacggtatgat

SEQ ID NO: 729415 - DNA, 25 bp, Artificial sequence
  Synthetic oligonucleotide
caactccgttagcgtacgattagaa

SEQ ID NO: 729416 - DNA, 25 bp, Artificial sequence
  Synthetic oligonucleotide
caactccgttagggtacgattagaa

SEQ ID NO: 729417 - DNA, 25 bp, Artificial sequence
  Synthetic oligonucleotide
tcactatcgacggttaaaccttcgt

SEQ ID NO: 729418 - DNA, 25 bp, Artificial sequence
  Synthetic oligonucleotide
tcactatcgacgcttaaaccttcgt

SEQ ID NO: 729419 - DNA, 25 bp, Artificial sequence
  Synthetic oligonucleotide
ctggttgacgcgatatacacttctt

SEQ ID NO: 729420 - DNA, 25 bp, Artificial sequence
  Synthetic oligonucleotide
gctcatacggtcccgtatatctaat

SEQ ID NO: 729421 - DNA, 25 bp, Artificial sequence
  Synthetic oligonucleotide
ataccatattgcgggtgcgtaacaa

SEQ ID NO: 729422 - DNA, 25 bp, Artificial sequence
  Synthetic oligonucleotide
gcttttccgaatcataccgtcttct

SEQ ID NO: 729423 - DNA, 25 bp, Artificial sequence
  Synthetic oligonucleotide
ctgtaatactctcgcgtagtctttc

SEQ ID NO: 729424 - DNA, 25 bp, Artificial sequence
  Synthetic oligonucleotide
ctgtaatactctggcgtagtctttc

SEQ ID NO: 729425 - DNA, 25 bp, Artificial sequence
  Synthetic oligonucleotide
gccatccgcgattagtcctttatat

SEQ ID NO: 729426 - DNA, 25 bp, Artificial sequence
  Synthetic oligonucleotide
agacaacgagcgaacaacggaattt

SEQ ID NO: 729427 - DNA, 25 bp, Artificial sequence
  Synthetic oligonucleotide
actctggacgataataccgcattga

SEQ ID NO: 729428 - DNA, 25 bp, Artificial sequence
  Synthetic oligonucleotide
tgttctttgcgccaatagacaccta

SEQ ID NO: 729429 - DNA, 25 bp, Artificial sequence
  Synthetic oligonucleotide
ctggttgacgcgttatacacttctt

SEQ ID NO: 729430 - DNA, 25 bp, Artificial sequence
  Synthetic oligonucleotide
tttactgtcacgacgtatgacctca

SEQ ID NO: 729431 - DNA, 25 bp, Artificial sequence
  Synthetic oligonucleotide
aaaacccgctatatgtcgctctaga

SEQ ID NO: 729432 - DNA, 25 bp, Artificial sequence
  Synthetic oligonucleotide
aaaacccgctatttgtcgctctaga

SEQ ID NO: 729433 - DNA, 25 bp, Artificial sequence
  Synthetic oligonucleotide
cgatcatctaccccgtaatactttc

SEQ ID NO: 729434 - DNA, 25 bp, Artificial sequence
  Synthetic oligonucleotide
cgatcatctaccgcgtaatactttc

SEQ ID NO: 729435 - DNA, 25 bp, Artificial sequence
  Synthetic oligonucleotide
gatactatcgcgcacgtatctttca

SEQ ID NO: 729436 - DNA, 25 bp, Artificial sequence
  Synthetic oligonucleotide
gatactatcgcggacgtatctttca

SEQ ID NO: 729437 - DNA, 25 bp, Artificial sequence
  Synthetic oligonucleotide
gctcatacggtcgcgtatatctaat

SEQ ID NO: 729438 - DNA, 25 bp, Artificial sequence
  Synthetic oligonucleotide
agaagggagcgttgtacgaatcata

SEQ ID NO: 729439 - DNA, 25 bp, Artificial sequence
  Synthetic oligonucleotide
actctggacgattataccgcattga

SEQ ID NO: 729440 - DNA, 25 bp, Artificial sequence
  Synthetic oligonucleotide
tttactgtcacgtcgtatgacctca

SEQ ID NO: 729441 - DNA, 25 bp, Artificial sequence
  Synthetic oligonucleotide
gacaaacgggtttgtacgtatgcat

SEQ ID NO: 729442 - DNA, 25 bp, Artificial sequence
  Synthetic oligonucleotide
gacaaacgggttagtacgtatgcat

SEQ ID NO: 729443 - DNA, 25 bp, Artificial sequence
  Synthetic oligonucleotide
catagaacgagcggtaatggctata

SEQ ID NO: 729444 - DNA, 25 bp, Artificial sequence
  Synthetic oligonucleotide
catagaacgagccgtaatggctata

SEQ ID NO: 729445 - DNA, 25 bp, Artificial sequence
  Synthetic oligonucleotide
gcttttccgaatgataccgtcttct

SEQ ID NO: 729446 - DNA, 25 bp, Artificial sequence
  Synthetic oligonucleotide
agaagggagcgtagtacgaatcata

SEQ ID NO: 729447 - DNA, 25 bp, Artificial sequence
  Synthetic oligonucleotide
tcaagtcgcgctaaagaatggcata

SEQ ID NO: 729448 - DNA, 25 bp, Artificial sequence
  Synthetic oligonucleotide
acttaatagctcctacgcggtatac

SEQ ID NO: 729449 - DNA, 25 bp, Artificial sequence
  Synthetic oligonucleotide
tcacttcgcgaccaatagtacattg

SEQ ID NO: 729450 - DNA, 25 bp, Artificial sequence
  Synthetic oligonucleotide
tcacttcgcgacgaatagtacattg

SEQ ID NO: 729451 - DNA, 25 bp, Artificial sequence
  Synthetic oligonucleotide
tgctttccgcgactaactaagtaca

SEQ ID NO: 729452 - DNA, 25 bp, Artificial sequence
  Synthetic oligonucleotide
tgctttccgcgagtaactaagtaca

SEQ ID NO: 729453 - DNA, 25 bp, Artificial sequence
  Synthetic oligonucleotide
ctgatcaatcgccctaacgatgata

SEQ ID NO: 729454 - DNA, 25 bp, Artificial sequence
  Synthetic oligonucleotide
atcattgaccggatacgtttcagca

SEQ ID NO: 729455 - DNA, 25 bp, Artificial sequence
  Synthetic oligonucleotide
taacggtgcgcgttataagacattg

SEQ ID NO: 729456 - DNA, 25 bp, Artificial sequence
  Synthetic oligonucleotide
tcaagtcgcgcttaagaatggcata

SEQ ID NO: 729457 - DNA, 25 bp, Artificial sequence
  Synthetic oligonucleotide
taaatgtcgtaccggcatagaagca

SEQ ID NO: 729458 - DNA, 25 bp, Artificial sequence
  Synthetic oligonucleotide
taaatgtcgtacgggcatagaagca

SEQ ID NO: 729459 - DNA, 25 bp, Artificial sequence
  Synthetic oligonucleotide
taggtttcgtaccgtcctatcgtta

SEQ ID NO: 729460 - DNA, 25 bp, Artificial sequence
  Synthetic oligonucleotide
ctaatccgatccaagatcgttccaa

SEQ ID NO: 729461 - DNA, 25 bp, Artificial sequence
  Synthetic oligonucleotide
ccctatcgcaattcgtcgattatac

SEQ ID NO: 729462 - DNA, 25 bp, Artificial sequence
  Synthetic oligonucleotide
atcattgaccggttacgtttcagca

SEQ ID NO: 729463 - DNA, 25 bp, Artificial sequence
  Synthetic oligonucleotide
ggttaacgcgattactacgcacata

SEQ ID NO: 729464 - DNA, 25 bp, Artificial sequence
  Synthetic oligonucleotide
ggcattcgcgacaaatctttacttg

SEQ ID NO: 729465 - DNA, 25 bp, Artificial sequence
  Synthetic oligonucleotide
ggcattcgcgactaatctttacttg

SEQ ID NO: 729466 - DNA, 25 bp, Artificial sequence
  Synthetic oligonucleotide
gtccaacgctacgtactacacataa

SEQ ID NO: 729467 - DNA, 25 bp, Artificial sequence
  Synthetic oligonucleotide
gtccaacgctacctactacacataa

SEQ ID NO: 729468 - DNA, 25 bp, Artificial sequence
  Synthetic oligonucleotide
actaggtacgttcggtactagatac

SEQ ID NO: 729469 - DNA, 25 bp, Artificial sequence
  Synthetic oligonucleotide
actaggtacgttgggtactagatac

SEQ ID NO: 729470 - DNA, 25 bp, Artificial sequence
  Synthetic oligonucleotide
acttaatagctcgtacgcggtatac

SEQ ID NO: 729471 - DNA, 25 bp, Artificial sequence
  Synthetic oligonucleotide
gtttgtgcgtcttgtatcgcgttaa

SEQ ID NO: 729472 - DNA, 25 bp, Artificial sequence
  Synthetic oligonucleotide
taacggtgcgcgatataagacattg

SEQ ID NO: 729473 - DNA, 25 bp, Artificial sequence
  Synthetic oligonucleotide
ggttaacgcgataactacgcacata

SEQ ID NO: 729474 - DNA, 25 bp, Artificial sequence
  Synthetic oligonucleotide
actagagctagatcgtcgtactctt

SEQ ID NO: 729475 - DNA, 25 bp, Artificial sequence
  Synthetic oligonucleotide
actagagctagaacgtcgtactctt

SEQ ID NO: 729476 - DNA, 25 bp, Artificial sequence
  Synthetic oligonucleotide
agtaaccgggacgtaatacactcaa

SEQ ID NO: 729477 - DNA, 25 bp, Artificial sequence
  Synthetic oligonucleotide
agtaaccgggacctaatacactcaa

SEQ ID NO: 729478 - DNA, 25 bp, Artificial sequence
  Synthetic oligonucleotide
tttacccgaccgttcgtacattatg

SEQ ID NO: 729479 - DNA, 25 bp, Artificial sequence
  Synthetic oligonucleotide
gtttgtgcgtctagtatcgcgttaa

SEQ ID NO: 729480 - DNA, 25 bp, Artificial sequence
  Synthetic oligonucleotide
atcagtaccgcgcataatggttttg

SEQ ID NO: 729481 - DNA, 25 bp, Artificial sequence
  Synthetic oligonucleotide
ccctatcgcaatacgtcgattatac

SEQ ID NO: 729482 - DNA, 25 bp, Artificial sequence
  Synthetic oligonucleotide
tcacttctaataggatcgctccagt

SEQ ID NO: 729483 - DNA, 25 bp, Artificial sequence
  Synthetic oligonucleotide
gaactactagtaacgcgaagtagct

SEQ ID NO: 729484 - DNA, 25 bp, Artificial sequence
  Synthetic oligonucleotide
gaactactagtatcgcgaagtagct

SEQ ID NO: 729485 - DNA, 25 bp, Artificial sequence
  Synthetic oligonucleotide
aataccatcaccctacgggctttat

SEQ ID NO: 729486 - DNA, 25 bp, Artificial sequence
  Synthetic oligonucleotide
aaagtcacatatggtcgcttccgat

SEQ ID NO: 729487 - DNA, 25 bp, Artificial sequence
  Synthetic oligonucleotide
tgttctttgcgcgaatagacaccta

SEQ ID NO: 729488 - DNA, 25 bp, Artificial sequence
  Synthetic oligonucleotide
aaagtcacatatcgtcgcttccgat

SEQ ID NO: 729489 - DNA, 25 bp, Artificial sequence
  Synthetic oligonucleotide
agctggctagtactacgcgtataaa

SEQ ID NO: 729490 - DNA, 25 bp, Artificial sequence
  Synthetic oligonucleotide
atcagtaccgcggataatggttttg

SEQ ID NO: 729491 - DNA, 25 bp, Artificial sequence
  Synthetic oligonucleotide
ctacgtcgtgacgattcgttattct

SEQ ID NO: 729492 - DNA, 25 bp, Artificial sequence
  Synthetic oligonucleotide
ctacgtcgtgaccattcgttattct

SEQ ID NO: 729493 - DNA, 25 bp, Artificial sequence
  Synthetic oligonucleotide
ggtatccgtatatccggtatagtga

SEQ ID NO: 729494 - DNA, 25 bp, Artificial sequence
  Synthetic oligonucleotide
ggtatccgtataaccggtatagtga

SEQ ID NO: 729495 - DNA, 25 bp, Artificial sequence
  Synthetic oligonucleotide
agctggctagtagtacgcgtataaa

SEQ ID NO: 729496 - DNA, 25 bp, Artificial sequence
  Synthetic oligonucleotide
gccatccgcgataagtcctttatat

SEQ ID NO: 729497 - DNA, 25 bp, Artificial sequence
  Synthetic oligonucleotide
tcaagagcgtaattcgacgagacta

SEQ ID NO: 729498 - DNA, 25 bp, Artificial sequence
  Synthetic oligonucleotide
taggtttcgtacggtcctatcgtta

SEQ ID NO: 729499 - DNA, 25 bp, Artificial sequence
  Synthetic oligonucleotide
tccagatctaagggcgcgatttaat

SEQ ID NO: 729500 - DNA, 25 bp, Artificial sequence
  Synthetic oligonucleotide
tccagatctaagcgcgcgatttaat

SEQ ID NO: 729501 - DNA, 25 bp, Artificial sequence
  Synthetic oligonucleotide
agtactcgtcgattcgtgatctagt

SEQ ID NO: 729502 - DNA, 25 bp, Artificial sequence
  Synthetic oligonucleotide
agtactcgtcgaatcgtgatctagt

SEQ ID NO: 729503 - DNA, 25 bp, Artificial sequence
  Synthetic oligonucleotide
agccaagtcgcgaaacaacgttata

SEQ ID NO: 729504 - DNA, 25 bp, Artificial sequence
  Synthetic oligonucleotide
tcacttctaatacgatcgctccagt

SEQ ID NO: 729505 - DNA, 25 bp, Artificial sequence
  Synthetic oligonucleotide
tcaagagcgtaaatcgacgagacta

SEQ ID NO: 729506 - DNA, 25 bp, Artificial sequence
  Synthetic oligonucleotide
tttacccgaccgatcgtacattatg

SEQ ID NO: 729507 - DNA, 25 bp, Artificial sequence
  Synthetic oligonucleotide
taattgttacgtggtgcgaaccctt

SEQ ID NO: 729508 - DNA, 25 bp, Artificial sequence
  Synthetic oligonucleotide
taattgttacgtcgtgcgaaccctt

SEQ ID NO: 729509 - DNA, 25 bp, Artificial sequence
  Synthetic oligonucleotide
ctttaccgtatattcgcgatgaagg

SEQ ID NO: 729510 - DNA, 25 bp, Artificial sequence
  Synthetic oligonucleotide
ctttaccgtataatcgcgatgaagg

SEQ ID NO: 729511 - DNA, 25 bp, Artificial sequence
  Synthetic oligonucleotide
tatttctaccgcacgttagatgagg

SEQ ID NO: 729512 - DNA, 25 bp, Artificial sequence
  Synthetic oligonucleotide
tatttctaccgctcgttagatgagg

SEQ ID NO: 729513 - DNA, 25 bp, Artificial sequence
  Synthetic oligonucleotide
agccaagtcgcgtaacaacgttata

SEQ ID NO: 729514 - DNA, 25 bp, Artificial sequence
  Synthetic oligonucleotide
ggactattacgagcgaagctcttaa

SEQ ID NO: 729515 - DNA, 25 bp, Artificial sequence
  Synthetic oligonucleotide
atttgacgcgatatacagggaccat

SEQ ID NO: 729516 - DNA, 25 bp, Artificial sequence
  Synthetic oligonucleotide
gttgttccgcgtacataagtgagtt

SEQ ID NO: 729517 - DNA, 25 bp, Artificial sequence
  Synthetic oligonucleotide
gttgttccgcgttcataagtgagtt

SEQ ID NO: 729518 - DNA, 25 bp, Artificial sequence
  Synthetic oligonucleotide
cgatcttcggcgattaacggttata

SEQ ID NO: 729519 - DNA, 25 bp, Artificial sequence
  Synthetic oligonucleotide
cgatcttcggcgtttaacggttata

SEQ ID NO: 729520 - DNA, 25 bp, Artificial sequence
  Synthetic oligonucleotide
gtgacagtaacggaatgcggatata

SEQ ID NO: 729521 - DNA, 25 bp, Artificial sequence
  Synthetic oligonucleotide
ccaagtcgattacgcgtacgaaata

SEQ ID NO: 729522 - DNA, 25 bp, Artificial sequence
  Synthetic oligonucleotide
ggactattacgaccgaagctcttaa

SEQ ID NO: 729523 - DNA, 25 bp, Artificial sequence
  Synthetic oligonucleotide
ctgatcaatcgcgctaacgatgata

SEQ ID NO: 729524 - DNA, 25 bp, Artificial sequence
  Synthetic oligonucleotide
tagcatatcgcgaataacgacgcat

SEQ ID NO: 729525 - DNA, 25 bp, Artificial sequence
  Synthetic oligonucleotide
tagcatatcgcgtataacgacgcat

SEQ ID NO: 729526 - DNA, 25 bp, Artificial sequence
  Synthetic oligonucleotide
acaggtggttcttctacgctctata

SEQ ID NO: 729527 - DNA, 25 bp, Artificial sequence
  Synthetic oligonucleotide
acaggtggttctactacgctctata

SEQ ID NO: 729528 - DNA, 25 bp, Artificial sequence
  Synthetic oligonucleotide
acgttacgcgtaaactagtgtcaga

SEQ ID NO: 729529 - DNA, 25 bp, Artificial sequence
  Synthetic oligonucleotide
acgttacgcgtatactagtgtcaga

SEQ ID NO: 729530 - DNA, 25 bp, Artificial sequence
  Synthetic oligonucleotide
atttgacgcgatttacagggaccat

SEQ ID NO: 729531 - DNA, 25 bp, Artificial sequence
  Synthetic oligonucleotide
gtgacagtaacgcaatgcggatata

SEQ ID NO: 729532 - DNA, 25 bp, Artificial sequence
  Synthetic oligonucleotide
gcattatcgtacgataggcgttttg

SEQ ID NO: 729533 - DNA, 25 bp, Artificial sequence
  Synthetic oligonucleotide
cactcacgtacgtagttagattcca

SEQ ID NO: 729534 - DNA, 25 bp, Artificial sequence
  Synthetic oligonucleotide
cactcacgtacgaagttagattcca

SEQ ID NO: 729535 - DNA, 25 bp, Artificial sequence
  Synthetic oligonucleotide
agtgtacgttcgggacatacaatgt

SEQ ID NO: 729536 - DNA, 25 bp, Artificial sequence
  Synthetic oligonucleotide
agtgtacgttcgcgacatacaatgt

SEQ ID NO: 729537 - DNA, 25 bp, Artificial sequence
  Synthetic oligonucleotide
tttttcagtatccacgcgtgtgtga

SEQ ID NO: 729538 - DNA, 25 bp, Artificial sequence
  Synthetic oligonucleotide
tttttcagtatcgacgcgtgtgtga

SEQ ID NO: 729539 - DNA, 25 bp, Artificial sequence
  Synthetic oligonucleotide
ccaagtcgattaggcgtacgaaata

SEQ ID NO: 729540 - DNA, 25 bp, Artificial sequence
  Synthetic oligonucleotide
ggttaagcgttcggatacggataat

SEQ ID NO: 729541 - DNA, 25 bp, Artificial sequence
  Synthetic oligonucleotide
gattgtcgcgcaatagatactgctt

SEQ ID NO: 729542 - DNA, 25 bp, Artificial sequence
  Synthetic oligonucleotide
gcattatcgtaccataggcgttttg

SEQ ID NO: 729543 - DNA, 25 bp, Artificial sequence
  Synthetic oligonucleotide
aacgggcgcgattcgtataattgtt

SEQ ID NO: 729544 - DNA, 25 bp, Artificial sequence
  Synthetic oligonucleotide
aacgggcgcgatacgtataattgtt

SEQ ID NO: 729545 - DNA, 25 bp, Artificial sequence
  Synthetic oligonucleotide
agatctggcgtattacgacacgaat

SEQ ID NO: 729546 - DNA, 25 bp, Artificial sequence
  Synthetic oligonucleotide
agatctggcgtaatacgacacgaat

SEQ ID NO: 729547 - DNA, 25 bp, Artificial sequence
  Synthetic oligonucleotide
ctaatccgatcctagatcgttccaa

SEQ ID NO: 729548 - DNA, 25 bp, Artificial sequence
  Synthetic oligonucleotide
gattgtcgcgcattagatactgctt

SEQ ID NO: 729549 - DNA, 25 bp, Artificial sequence
  Synthetic oligonucleotide
ggttaagcgttccgatacggataat

SEQ ID NO: 729550 - DNA, 25 bp, Artificial sequence
  Synthetic oligonucleotide
taaagtcgacccgactagtataagc

SEQ ID NO: 729551 - DNA, 25 bp, Artificial sequence
  Synthetic oligonucleotide
tcggctatagggggcgtaattaatt

SEQ ID NO: 729552 - DNA, 25 bp, Artificial sequence
  Synthetic oligonucleotide
tattgttagtccctcgcaaggttag

SEQ ID NO: 729553 - DNA, 25 bp, Artificial sequence
  Synthetic oligonucleotide
catcgtcgacgaccgctaattaaat

SEQ ID NO: 729554 - DNA, 25 bp, Artificial sequence
  Synthetic oligonucleotide
ctttcggattacctacgcgaaacaa

SEQ ID NO: 729555 - DNA, 25 bp, Artificial sequence
  Synthetic oligonucleotide
ctttcggattacgtacgcgaaacaa

SEQ ID NO: 729556 - DNA, 25 bp, Artificial sequence
  Synthetic oligonucleotide
atactgaacgcgctatcggatttga

SEQ ID NO: 729557 - DNA, 25 bp, Artificial sequence
  Synthetic oligonucleotide
tcggctatagggcgcgtaattaatt

SEQ ID NO: 729558 - DNA, 25 bp, Artificial sequence
  Synthetic oligonucleotide
taaagtcgaccccactagtataagc

SEQ ID NO: 729559 - DNA, 25 bp, Artificial sequence
  Synthetic oligonucleotide
tattgttagtccgtcgcaaggttag

SEQ ID NO: 729560 - DNA, 25 bp, Artificial sequence
  Synthetic oligonucleotide
tagtacgtatcagcgtacgctgtaa

SEQ ID NO: 729561 - DNA, 25 bp, Artificial sequence
  Synthetic oligonucleotide
tagtacgtatcaccgtacgctgtaa

SEQ ID NO: 729562 - DNA, 25 bp, Artificial sequence
  Synthetic oligonucleotide
gtcctttaattcgggcgtatgactt

SEQ ID NO: 729563 - DNA, 25 bp, Artificial sequence
  Synthetic oligonucleotide
gtcctttaattccggcgtatgactt

SEQ ID NO: 729564 - DNA, 25 bp, Artificial sequence
  Synthetic oligonucleotide
atgatcgtcgacccaagtagtaagt

SEQ ID NO: 729565 - DNA, 25 bp, Artificial sequence
  Synthetic oligonucleotide
atgatcgtcgacgcaagtagtaagt

SEQ ID NO: 729566 - DNA, 25 bp, Artificial sequence
  Synthetic oligonucleotide
attccgagaacgagcggtaatttgt

SEQ ID NO: 729567 - DNA, 25 bp, Artificial sequence
  Synthetic oligonucleotide
atactgaacgcggtatcggatttga

SEQ ID NO: 729568 - DNA, 25 bp, Artificial sequence
  Synthetic oligonucleotide
ctgatgtcgtactacggctacatat

SEQ ID NO: 729569 - DNA, 25 bp, Artificial sequence
  Synthetic oligonucleotide
attccgagaacgtgcggtaatttgt

SEQ ID NO: 729570 - DNA, 25 bp, Artificial sequence
  Synthetic oligonucleotide
atgcaccgcgattctaaagactcaa

SEQ ID NO: 729571 - DNA, 25 bp, Artificial sequence
  Synthetic oligonucleotide
catcgtcgacgagcgctaattaaat

SEQ ID NO: 729572 - DNA, 25 bp, Artificial sequence
  Synthetic oligonucleotide
atgcaccgcgatactaaagactcaa

SEQ ID NO: 729573 - DNA, 25 bp, Artificial sequence
  Synthetic oligonucleotide
atcagactatattcgtccgggtttg

SEQ ID NO: 729574 - DNA, 25 bp, Artificial sequence
  Synthetic oligonucleotide
ctgatgtcgtacaacggctacatat

SEQ ID NO: 729575 - DNA, 25 bp, Artificial sequence
  Synthetic oligonucleotide
aagtagatccgctattgcgacgtaa

SEQ ID NO: 729576 - DNA, 25 bp, Artificial sequence
  Synthetic oligonucleotide
aagtagatccgcaattgcgacgtaa

SEQ ID NO: 729577 - DNA, 25 bp, Artificial sequence
  Synthetic oligonucleotide
atctcagctcgaaagaacgggaaat

SEQ ID NO: 729578 - DNA, 25 bp, Artificial sequence
  Synthetic oligonucleotide
atctcagctcgatagaacgggaaat

SEQ ID NO: 729579 - DNA, 25 bp, Artificial sequence
  Synthetic oligonucleotide
tacaacgatcgactatacgacacca

SEQ ID NO: 729580 - DNA, 25 bp, Artificial sequence
  Synthetic oligonucleotide
tacaacgatcgagtatacgacacca

SEQ ID NO: 729581 - DNA, 25 bp, Artificial sequence
  Synthetic oligonucleotide
atcagactatatacgtccgggtttg

SEQ ID NO: 729582 - DNA, 25 bp, Artificial sequence
  Synthetic oligonucleotide
acttcttaaacgcctgtcgcatcct

SEQ ID NO: 729583 - DNA, 25 bp, Artificial sequence
  Synthetic oligonucleotide
acgttcgcgtattcgatactggatc

SEQ ID NO: 729584 - DNA, 25 bp, Artificial sequence
  Synthetic oligonucleotide
agtaggcgctatgtaaccgtaacag

SEQ ID NO: 729585 - DNA, 25 bp, Artificial sequence
  Synthetic oligonucleotide
agtaggcgctatctaaccgtaacag

SEQ ID NO: 729586 - DNA, 25 bp, Artificial sequence
  Synthetic oligonucleotide
agtctagatacgctcggtaaactcg

SEQ ID NO: 729587 - DNA, 25 bp, Artificial sequence
  Synthetic oligonucleotide
agtctagatacggtcggtaaactcg

SEQ ID NO: 729588 - DNA, 25 bp, Artificial sequence
  Synthetic oligonucleotide
ttcgaatatgtcgttcgcgttgcca

SEQ ID NO: 729589 - DNA, 25 bp, Artificial sequence
  Synthetic oligonucleotide
gcaaagcgtatcgctaggagtttac

SEQ ID NO: 729590 - DNA, 25 bp, Artificial sequence
  Synthetic oligonucleotide
gggacgtatagtaacgcgaataacg

SEQ ID NO: 729591 - DNA, 25 bp, Artificial sequence
  Synthetic oligonucleotide
acttcttaaacggctgtcgcatcct

SEQ ID NO: 729592 - DNA, 25 bp, Artificial sequence
  Synthetic oligonucleotide
actgacggtaacggcgttagttgta

SEQ ID NO: 729593 - DNA, 25 bp, Artificial sequence
  Synthetic oligonucleotide
actgacggtaaccgcgttagttgta

SEQ ID NO: 729594 - DNA, 25 bp, Artificial sequence
  Synthetic oligonucleotide
tctaagtcgacgggggataattcga

SEQ ID NO: 729595 - DNA, 25 bp, Artificial sequence
  Synthetic oligonucleotide
tctaagtcgacgcgggataattcga

SEQ ID NO: 729596 - DNA, 25 bp, Artificial sequence
  Synthetic oligonucleotide
ggctagcaccgaggtaataatacgt

SEQ ID NO: 729597 - DNA, 25 bp, Artificial sequence
  Synthetic oligonucleotide
gcaaagcgtatccctaggagtttac

SEQ ID NO: 729598 - DNA, 25 bp, Artificial sequence
  Synthetic oligonucleotide
agtttacgcccgtatactacaacgc

SEQ ID NO: 729599 - DNA, 25 bp, Artificial sequence
  Synthetic oligonucleotide
ttacttcgtgactagcgactgttcg

SEQ ID NO: 729600 - DNA, 25 bp, Artificial sequence
  Synthetic oligonucleotide
ggctagcaccgacgtaataatacgt

SEQ ID NO: 729601 - DNA, 25 bp, Artificial sequence
  Synthetic oligonucleotide
gggacgtatagttacgcgaataacg

SEQ ID NO: 729602 - DNA, 25 bp, Artificial sequence
  Synthetic oligonucleotide
attgtaatcgtagatcgcggcagac

SEQ ID NO: 729603 - DNA, 25 bp, Artificial sequence
  Synthetic oligonucleotide
attgtaatcgtacatcgcggcagac

SEQ ID NO: 729604 - DNA, 25 bp, Artificial sequence
  Synthetic oligonucleotide
acgttcgcgtatacgatactggatc

SEQ ID NO: 729605 - DNA, 25 bp, Artificial sequence
  Synthetic oligonucleotide
agaaaacgtcgtttacggactgcct

SEQ ID NO: 729606 - DNA, 25 bp, Artificial sequence
  Synthetic oligonucleotide
agaaaacgtcgtatacggactgcct

SEQ ID NO: 729607 - DNA, 25 bp, Artificial sequence
  Synthetic oligonucleotide
ccacttgtgtgcgacgtaacagata

SEQ ID NO: 729608 - DNA, 25 bp, Artificial sequence
  Synthetic oligonucleotide
ccacttgtgtgccacgtaacagata

SEQ ID NO: 729609 - DNA, 25 bp, Artificial sequence
  Synthetic oligonucleotide
caacgaggtacgggatagttgttga

SEQ ID NO: 729610 - DNA, 25 bp, Artificial sequence
  Synthetic oligonucleotide
ttcgaatatgtccttcgcgttgcca

SEQ ID NO: 729611 - DNA, 25 bp, Artificial sequence
  Synthetic oligonucleotide
caacgaggtacgcgatagttgttga

SEQ ID NO: 729612 - DNA, 25 bp, Artificial sequence
  Synthetic oligonucleotide
gagtttttacgcgatggacgatcct

SEQ ID NO: 729613 - DNA, 25 bp, Artificial sequence
  Synthetic oligonucleotide
agtttacgcccgaatactacaacgc

SEQ ID NO: 729614 - DNA, 25 bp, Artificial sequence
  Synthetic oligonucleotide
tcttctacccgcctatacgacagta

SEQ ID NO: 729615 - DNA, 25 bp, Artificial sequence
  Synthetic oligonucleotide
ggtcaaatcgcgtcgtataaggagt

SEQ ID NO: 729616 - DNA, 25 bp, Artificial sequence
  Synthetic oligonucleotide
ggtcaaatcgcgacgtataaggagt

SEQ ID NO: 729617 - DNA, 25 bp, Artificial sequence
  Synthetic oligonucleotide
ttctctcttcgcgaactaggcgaaa

SEQ ID NO: 729618 - DNA, 25 bp, Artificial sequence
  Synthetic oligonucleotide
ttctctcttcgccaactaggcgaaa

SEQ ID NO: 729619 - DNA, 25 bp, Artificial sequence
  Synthetic oligonucleotide
caaaactctacgcgatactccgttg

SEQ ID NO: 729620 - DNA, 25 bp, Artificial sequence
  Synthetic oligonucleotide
tggtgatacggtacgtaagccgtaa

SEQ ID NO: 729621 - DNA, 25 bp, Artificial sequence
  Synthetic oligonucleotide
tcttctacccgcgtatacgacagta

SEQ ID NO: 729622 - DNA, 25 bp, Artificial sequence
  Synthetic oligonucleotide
atcgtaaacgtcgggacgatcagat

SEQ ID NO: 729623 - DNA, 25 bp, Artificial sequence
  Synthetic oligonucleotide
gaggtgctaacgttcgcgttaatac

SEQ ID NO: 729624 - DNA, 25 bp, Artificial sequence
  Synthetic oligonucleotide
gaggtgctaacgatcgcgttaatac

SEQ ID NO: 729625 - DNA, 25 bp, Artificial sequence
  Synthetic oligonucleotide
aaagagaccgtaggctacgccataa

SEQ ID NO: 729626 - DNA, 25 bp, Artificial sequence
  Synthetic oligonucleotide
aaagagaccgtacgctacgccataa

SEQ ID NO: 729627 - DNA, 25 bp, Artificial sequence
  Synthetic oligonucleotide
acatctttcgcgggcatagttgctt

SEQ ID NO: 729628 - DNA, 25 bp, Artificial sequence
  Synthetic oligonucleotide
gagtttttacgccatggacgatcct

SEQ ID NO: 729629 - DNA, 25 bp, Artificial sequence
  Synthetic oligonucleotide
caaaactctacgggatactccgttg

SEQ ID NO: 729630 - DNA, 25 bp, Artificial sequence
  Synthetic oligonucleotide
tgtgtcaatacgtcgtccggatcta

SEQ ID NO: 729631 - DNA, 25 bp, Artificial sequence
  Synthetic oligonucleotide
atcccagtcgtttcgcgatcaaaca

SEQ ID NO: 729632 - DNA, 25 bp, Artificial sequence
  Synthetic oligonucleotide
atcaatgccgaccgtataagctctc

SEQ ID NO: 729633 - DNA, 25 bp, Artificial sequence
  Synthetic oligonucleotide
atcaatgccgacggtataagctctc

SEQ ID NO: 729634 - DNA, 25 bp, Artificial sequence
  Synthetic oligonucleotide
tcgattgtcgcgtagtatccctttg

SEQ ID NO: 729635 - DNA, 25 bp, Artificial sequence
  Synthetic oligonucleotide
tcgattgtcgcgaagtatccctttg

SEQ ID NO: 729636 - DNA, 25 bp, Artificial sequence
  Synthetic oligonucleotide
gtgtaaactaatttcgcgcggatcg

SEQ ID NO: 729637 - DNA, 25 bp, Artificial sequence
  Synthetic oligonucleotide
atcgtaaacgtccggacgatcagat

SEQ ID NO: 729638 - DNA, 25 bp, Artificial sequence
  Synthetic oligonucleotide
tgtgtcaatacgacgtccggatcta

SEQ ID NO: 729639 - DNA, 25 bp, Artificial sequence
  Synthetic oligonucleotide
ttacttcgtgacaagcgactgttcg

SEQ ID NO: 729640 - DNA, 25 bp, Artificial sequence
  Synthetic oligonucleotide
tatccgtcgcgttagcctattacac

SEQ ID NO: 729641 - DNA, 25 bp, Artificial sequence
  Synthetic oligonucleotide
tatccgtcgcgtaagcctattacac

SEQ ID NO: 729642 - DNA, 25 bp, Artificial sequence
  Synthetic oligonucleotide
attggcctatgccccgcattcataa

SEQ ID NO: 729643 - DNA, 25 bp, Artificial sequence
  Synthetic oligonucleotide
attggcctatgcgccgcattcataa

SEQ ID NO: 729644 - DNA, 25 bp, Artificial sequence
  Synthetic oligonucleotide
tggtgatacggttcgtaagccgtaa

SEQ ID NO: 729645 - DNA, 25 bp, Artificial sequence
  Synthetic oligonucleotide
atcccagtcgttacgcgatcaaaca

SEQ ID NO: 729646 - DNA, 25 bp, Artificial sequence
  Synthetic oligonucleotide
gtgtaaactaatatcgcgcggatcg

SEQ ID NO: 729647 - DNA, 25 bp, Artificial sequence
  Synthetic oligonucleotide
tgtcccctcgatacgtcgagaattt

SEQ ID NO: 729648 - DNA, 25 bp, Artificial sequence
  Synthetic oligonucleotide
caaaacgtctcgggttatgcagttc

SEQ ID NO: 729649 - DNA, 25 bp, Artificial sequence
  Synthetic oligonucleotide
caaaacgtctcgcgttatgcagttc

SEQ ID NO: 729650 - DNA, 25 bp, Artificial sequence
  Synthetic oligonucleotide
ctaagagcgcgattatactagggtc

SEQ ID NO: 729651 - DNA, 25 bp, Artificial sequence
  Synthetic oligonucleotide
ctaagagcgcgaatatactagggtc

SEQ ID NO: 729652 - DNA, 25 bp, Artificial sequence
  Synthetic oligonucleotide
cctcatgcgtaaggggattctgata

SEQ ID NO: 729653 - DNA, 25 bp, Artificial sequence
  Synthetic oligonucleotide
cctcatgcgtaacgggattctgata

SEQ ID NO: 729654 - DNA, 25 bp, Artificial sequence
  Synthetic oligonucleotide
gtaagggcggtcgacgtaatttcaa

SEQ ID NO: 729655 - DNA, 25 bp, Artificial sequence
  Synthetic oligonucleotide
gacgattacgtctcgacgttgagaa

SEQ ID NO: 729656 - DNA, 25 bp, Artificial sequence
  Synthetic oligonucleotide
tgtcccctcgattcgtcgagaattt

SEQ ID NO: 729657 - DNA, 25 bp, Artificial sequence
  Synthetic oligonucleotide
agcgtccgatcgaacgttgattgat

SEQ ID NO: 729658 - DNA, 25 bp, Artificial sequence
  Synthetic oligonucleotide
ggtgattatacgaccgcaacagaac

SEQ ID NO: 729659 - DNA, 25 bp, Artificial sequence
  Synthetic oligonucleotide
ggtgattatacgtccgcaacagaac

SEQ ID NO: 729660 - DNA, 25 bp, Artificial sequence
  Synthetic oligonucleotide
cagaccccgacgtgtaatgtgtaat

SEQ ID NO: 729661 - DNA, 25 bp, Artificial sequence
  Synthetic oligonucleotide
cagaccccgacgagtaatgtgtaat

SEQ ID NO: 729662 - DNA, 25 bp, Artificial sequence
  Synthetic oligonucleotide
tccttccgtaaggacgtattcacca

SEQ ID NO: 729663 - DNA, 25 bp, Artificial sequence
  Synthetic oligonucleotide
tccttccgtaagcacgtattcacca

SEQ ID NO: 729664 - DNA, 25 bp, Artificial sequence
  Synthetic oligonucleotide
aatatgacatgcaacgtcggcatgc

SEQ ID NO: 729665 - DNA, 25 bp, Artificial sequence
  Synthetic oligonucleotide
gtaagggcggtccacgtaatttcaa

SEQ ID NO: 729666 - DNA, 25 bp, Artificial sequence
  Synthetic oligonucleotide
cggttttatcgactagcgtagagga

SEQ ID NO: 729667 - DNA, 25 bp, Artificial sequence
  Synthetic oligonucleotide
aagctgacacccctcgatactaagt

SEQ ID NO: 729668 - DNA, 25 bp, Artificial sequence
  Synthetic oligonucleotide
acaacacgttattcgcgatcccatg

SEQ ID NO: 729669 - DNA, 25 bp, Artificial sequence
  Synthetic oligonucleotide
tccattcgtaccgttgtatggtagc

SEQ ID NO: 729670 - DNA, 25 bp, Artificial sequence
  Synthetic oligonucleotide
tccattcgtacccttgtatggtagc

SEQ ID NO: 729671 - DNA, 25 bp, Artificial sequence
  Synthetic oligonucleotide
gattaaggttcgggcgtaacggaaa

SEQ ID NO: 729672 - DNA, 25 bp, Artificial sequence
  Synthetic oligonucleotide
gattaaggttcgcgcgtaacggaaa

SEQ ID NO: 729673 - DNA, 25 bp, Artificial sequence
  Synthetic oligonucleotide
aagtgggttagtgcgcgatgtgtaa

SEQ ID NO: 729674 - DNA, 25 bp, Artificial sequence
  Synthetic oligonucleotide
gacgattacgtcacgacgttgagaa

SEQ ID NO: 729675 - DNA, 25 bp, Artificial sequence
  Synthetic oligonucleotide
cggttttatcgagtagcgtagagga

SEQ ID NO: 729676 - DNA, 25 bp, Artificial sequence
  Synthetic oligonucleotide
acatctttcgcgcgcatagttgctt

SEQ ID NO: 729677 - DNA, 25 bp, Artificial sequence
  Synthetic oligonucleotide
ctctaaatggtttgacgcgctacgt

SEQ ID NO: 729678 - DNA, 25 bp, Artificial sequence
  Synthetic oligonucleotide
ctctaaatggttagacgcgctacgt

SEQ ID NO: 729679 - DNA, 25 bp, Artificial sequence
  Synthetic oligonucleotide
ttatattctcaaggcgcctagtggc

SEQ ID NO: 729680 - DNA, 25 bp, Artificial sequence
  Synthetic oligonucleotide
ttatattctcaacgcgcctagtggc

SEQ ID NO: 729681 - DNA, 25 bp, Artificial sequence
  Synthetic oligonucleotide
tttgattatcgcgctagttctcccg

SEQ ID NO: 729682 - DNA, 25 bp, Artificial sequence
  Synthetic oligonucleotide
tttgattatcgccctagttctcccg

SEQ ID NO: 729683 - DNA, 25 bp, Artificial sequence
  Synthetic oligonucleotide
agcgtccgatcgtacgttgattgat

SEQ ID NO: 729684 - DNA, 25 bp, Artificial sequence
  Synthetic oligonucleotide
gtatctgacgatacgccgagaacat

SEQ ID NO: 729685 - DNA, 25 bp, Artificial sequence
  Synthetic oligonucleotide
aagtgggttagtccgcgatgtgtaa

SEQ ID NO: 729686 - DNA, 25 bp, Artificial sequence
  Synthetic oligonucleotide
cacgcacttcgacttacggatgttt

SEQ ID NO: 729687 - DNA, 25 bp, Artificial sequence
  Synthetic oligonucleotide
aatatgacatgctacgtcggcatgc

SEQ ID NO: 729688 - DNA, 25 bp, Artificial sequence
  Synthetic oligonucleotide
gacacttaatcggcgtatggggaat

SEQ ID NO: 729689 - DNA, 25 bp, Artificial sequence
  Synthetic oligonucleotide
gacacttaatcgccgtatggggaat

SEQ ID NO: 729690 - DNA, 25 bp, Artificial sequence
  Synthetic oligonucleotide
tatcccgtagtagttcgcgagtact

SEQ ID NO: 729691 - DNA, 25 bp, Artificial sequence
  Synthetic oligonucleotide
tatcccgtagtacttcgcgagtact

SEQ ID NO: 729692 - DNA, 25 bp, Artificial sequence
  Synthetic oligonucleotide
agataccgcggttcgtaaatactgc

SEQ ID NO: 729693 - DNA, 25 bp, Artificial sequence
  Synthetic oligonucleotide
agataccgcggtacgtaaatactgc

SEQ ID NO: 729694 - DNA, 25 bp, Artificial sequence
  Synthetic oligonucleotide
tatccacggacgtactaggtaacct

SEQ ID NO: 729695 - DNA, 25 bp, Artificial sequence
  Synthetic oligonucleotide
tgtgcaacggttcgctaaccgttaa

SEQ ID NO: 729696 - DNA, 25 bp, Artificial sequence
  Synthetic oligonucleotide
aaaggtcgcgtaatgaggtgacctt

SEQ ID NO: 729697 - DNA, 25 bp, Artificial sequence
  Synthetic oligonucleotide
cacgcacttcgagttacggatgttt

SEQ ID NO: 729698 - DNA, 25 bp, Artificial sequence
  Synthetic oligonucleotide
agcaacttgacgccgctatactcat

SEQ ID NO: 729699 - DNA, 25 bp, Artificial sequence
  Synthetic oligonucleotide
agcaacttgacggcgctatactcat

SEQ ID NO: 729700 - DNA, 25 bp, Artificial sequence
  Synthetic oligonucleotide
tactgtgtatcgggtaccaacgttg

SEQ ID NO: 729701 - DNA, 25 bp, Artificial sequence
  Synthetic oligonucleotide
tactgtgtatcgcgtaccaacgttg

SEQ ID NO: 729702 - DNA, 25 bp, Artificial sequence
  Synthetic oligonucleotide
agatgaatcgtaggaacgcggtgaa

SEQ ID NO: 729703 - DNA, 25 bp, Artificial sequence
  Synthetic oligonucleotide
agatgaatcgtacgaacgcggtgaa

SEQ ID NO: 729704 - DNA, 25 bp, Artificial sequence
  Synthetic oligonucleotide
gcaagttgtcgaggctattaatgcc

SEQ ID NO: 729705 - DNA, 25 bp, Artificial sequence
  Synthetic oligonucleotide
tgtgcaacggttggctaaccgttaa

SEQ ID NO: 729706 - DNA, 25 bp, Artificial sequence
  Synthetic oligonucleotide
gtcgctgacttcccgacgttattta

SEQ ID NO: 729707 - DNA, 25 bp, Artificial sequence
  Synthetic oligonucleotide
gcaagttgtcgacgctattaatgcc

SEQ ID NO: 729708 - DNA, 25 bp, Artificial sequence
  Synthetic oligonucleotide
ttacccatgtcgaatagcggaaagg

SEQ ID NO: 729709 - DNA, 25 bp, Artificial sequence
  Synthetic oligonucleotide
ttacccatgtcgtatagcggaaagg

SEQ ID NO: 729710 - DNA, 25 bp, Artificial sequence
  Synthetic oligonucleotide
cgcataaacgagtcgtatctgcatc

SEQ ID NO: 729711 - DNA, 25 bp, Artificial sequence
  Synthetic oligonucleotide
cgcataaacgagacgtatctgcatc

SEQ ID NO: 729712 - DNA, 25 bp, Artificial sequence
  Synthetic oligonucleotide
caaacatcgacgtctaacgggtaac

SEQ ID NO: 729713 - DNA, 25 bp, Artificial sequence
  Synthetic oligonucleotide
caaacatcgacgactaacgggtaac

SEQ ID NO: 729714 - DNA, 25 bp, Artificial sequence
  Synthetic oligonucleotide
tatccacggacgaactaggtaacct

SEQ ID NO: 729715 - DNA, 25 bp, Artificial sequence
  Synthetic oligonucleotide
gaatactaacgggtccgaaccgata

SEQ ID NO: 729716 - DNA, 25 bp, Artificial sequence
  Synthetic oligonucleotide
gtatctgacgattcgccgagaacat

SEQ ID NO: 729717 - DNA, 25 bp, Artificial sequence
  Synthetic oligonucleotide
gtcgctgacttcgcgacgttattta

SEQ ID NO: 729718 - DNA, 25 bp, Artificial sequence
  Synthetic oligonucleotide
caccccccattaaaacgcgaagtat

SEQ ID NO: 729719 - DNA, 25 bp, Artificial sequence
  Synthetic oligonucleotide
caccccccattataacgcgaagtat

SEQ ID NO: 729720 - DNA, 25 bp, Artificial sequence
  Synthetic oligonucleotide
gactatagcgcgtctattggcatga

SEQ ID NO: 729721 - DNA, 25 bp, Artificial sequence
  Synthetic oligonucleotide
gactatagcgcgactattggcatga

SEQ ID NO: 729722 - DNA, 25 bp, Artificial sequence
  Synthetic oligonucleotide
atctcaagccgagcgtaatagccat

SEQ ID NO: 729723 - DNA, 25 bp, Artificial sequence
  Synthetic oligonucleotide
atctcaagccgaccgtaatagccat

SEQ ID NO: 729724 - DNA, 25 bp, Artificial sequence
  Synthetic oligonucleotide
aaaggtcgcgtattgaggtgacctt

SEQ ID NO: 729725 - DNA, 25 bp, Artificial sequence
  Synthetic oligonucleotide
gaatactaacggctccgaaccgata

SEQ ID NO: 729726 - DNA, 25 bp, Artificial sequence
  Synthetic oligonucleotide
tgctcttactaaggcgtagccagat

SEQ ID NO: 729727 - DNA, 25 bp, Artificial sequence
  Synthetic oligonucleotide
ggctttcgtctactaacggttcagt

SEQ ID NO: 729728 - DNA, 25 bp, Artificial sequence
  Synthetic oligonucleotide
ggagctcgtattcgagcgttttaag

SEQ ID NO: 729729 - DNA, 25 bp, Artificial sequence
  Synthetic oligonucleotide
ccatgtggtaccgcgatatctcttt

SEQ ID NO: 729730 - DNA, 25 bp, Artificial sequence
  Synthetic oligonucleotide
ccatgtggtaccccgatatctcttt

SEQ ID NO: 729731 - DNA, 25 bp, Artificial sequence
  Synthetic oligonucleotide
tttctcttcgcggtcggtacatgta

SEQ ID NO: 729732 - DNA, 25 bp, Artificial sequence
  Synthetic oligonucleotide
ccaaatttgcgccgactattggaac

SEQ ID NO: 729733 - DNA, 25 bp, Artificial sequence
  Synthetic oligonucleotide
tgctcttactaacgcgtagccagat

SEQ ID NO: 729734 - DNA, 25 bp, Artificial sequence
  Synthetic oligonucleotide
ccaaatttgcgcggactattggaac

SEQ ID NO: 729735 - DNA, 25 bp, Artificial sequence
  Synthetic oligonucleotide
acaacacgttatacgcgatcccatg

SEQ ID NO: 729736 - DNA, 25 bp, Artificial sequence
  Synthetic oligonucleotide
gactaacgatacccaaggtttccac

SEQ ID NO: 729737 - DNA, 25 bp, Artificial sequence
  Synthetic oligonucleotide
tgaagcatgtaaaacgccggatagg

SEQ ID NO: 729738 - DNA, 25 bp, Artificial sequence
  Synthetic oligonucleotide
tgaagcatgtaatacgccggatagg

SEQ ID NO: 729739 - DNA, 25 bp, Artificial sequence
  Synthetic oligonucleotide
ttcagcacgtaccatacgccgtata

SEQ ID NO: 729740 - DNA, 25 bp, Artificial sequence
  Synthetic oligonucleotide
acactctcgtacctcggctgaatat

SEQ ID NO: 729741 - DNA, 25 bp, Artificial sequence
  Synthetic oligonucleotide
tttctcttcgcgctcggtacatgta

SEQ ID NO: 729742 - DNA, 25 bp, Artificial sequence
  Synthetic oligonucleotide
gtgtatgtgcgtaatgtcgccagat

SEQ ID NO: 729743 - DNA, 25 bp, Artificial sequence
  Synthetic oligonucleotide
atagcatagcgcaacgagacatggt

SEQ ID NO: 729744 - DNA, 25 bp, Artificial sequence
  Synthetic oligonucleotide
gtaactttaacgggcgtactgtcac

SEQ ID NO: 729745 - DNA, 25 bp, Artificial sequence
  Synthetic oligonucleotide
cctactatatacctcgccttcgaca

SEQ ID NO: 729746 - DNA, 25 bp, Artificial sequence
  Synthetic oligonucleotide
cctactatatacgtcgccttcgaca

SEQ ID NO: 729747 - DNA, 25 bp, Artificial sequence
  Synthetic oligonucleotide
gctagactaagtcgcgcatagagaa

SEQ ID NO: 729748 - DNA, 25 bp, Artificial sequence
  Synthetic oligonucleotide
ggagctcgtattggagcgttttaag

SEQ ID NO: 729749 - DNA, 25 bp, Artificial sequence
  Synthetic oligonucleotide
gtgtatgtgcgttatgtcgccagat

SEQ ID NO: 729750 - DNA, 25 bp, Artificial sequence
  Synthetic oligonucleotide
ggctttcgtctagtaacggttcagt

SEQ ID NO: 729751 - DNA, 25 bp, Artificial sequence
  Synthetic oligonucleotide
actggaaccctacgaatcggttatc

SEQ ID NO: 729752 - DNA, 25 bp, Artificial sequence
  Synthetic oligonucleotide
actggaaccctaggaatcggttatc

SEQ ID NO: 729753 - DNA, 25 bp, Artificial sequence
  Synthetic oligonucleotide
taattttcgcgggaggtaaaggctc

SEQ ID NO: 729754 - DNA, 25 bp, Artificial sequence
  Synthetic oligonucleotide
taattttcgcggcaggtaaaggctc

SEQ ID NO: 729755 - DNA, 25 bp, Artificial sequence
  Synthetic oligonucleotide
atagtgatacgtggttcggtggtgt

SEQ ID NO: 729756 - DNA, 25 bp, Artificial sequence
  Synthetic oligonucleotide
atagtgatacgtcgttcggtggtgt

SEQ ID NO: 729757 - DNA, 25 bp, Artificial sequence
  Synthetic oligonucleotide
gctagactaagtggcgcatagagaa

SEQ ID NO: 729758 - DNA, 25 bp, Artificial sequence
  Synthetic oligonucleotide
cacgtatcgcaaggtatacgaatcc

SEQ ID NO: 729759 - DNA, 25 bp, Artificial sequence
  Synthetic oligonucleotide
ttcagcacgtacgatacgccgtata

SEQ ID NO: 729760 - DNA, 25 bp, Artificial sequence
  Synthetic oligonucleotide
gcaactggtattaacgccgtatggt

SEQ ID NO: 729761 - DNA, 25 bp, Artificial sequence
  Synthetic oligonucleotide
ctacacaccgcgtaataggtgatgt

SEQ ID NO: 729762 - DNA, 25 bp, Artificial sequence
  Synthetic oligonucleotide
ctacacaccgcgaaataggtgatgt

SEQ ID NO: 729763 - DNA, 25 bp, Artificial sequence
  Synthetic oligonucleotide
gtttacacgcgcgaactatgcgaaa

SEQ ID NO: 729764 - DNA, 25 bp, Artificial sequence
  Synthetic oligonucleotide
tgttctaacgtagcgctcgcatcta

SEQ ID NO: 729765 - DNA, 25 bp, Artificial sequence
  Synthetic oligonucleotide
cacgtatcgcaacgtatacgaatcc

SEQ ID NO: 729766 - DNA, 25 bp, Artificial sequence
  Synthetic oligonucleotide
tgttctaacgtaccgctcgcatcta

SEQ ID NO: 729767 - DNA, 25 bp, Artificial sequence
  Synthetic oligonucleotide
tagaacgcgcgtacaatcaggcatt

SEQ ID NO: 729768 - DNA, 25 bp, Artificial sequence
  Synthetic oligonucleotide
tagaacgcgcgttcaatcaggcatt

SEQ ID NO: 729769 - DNA, 25 bp, Artificial sequence
  Synthetic oligonucleotide
gttatccgcgatggaacgaatctgt

SEQ ID NO: 729770 - DNA, 25 bp, Artificial sequence
  Synthetic oligonucleotide
gttatccgcgatcgaacgaatctgt

SEQ ID NO: 729771 - DNA, 25 bp, Artificial sequence
  Synthetic oligonucleotide
taatatattcgccgcgactgaccag

SEQ ID NO: 729772 - DNA, 25 bp, Artificial sequence
  Synthetic oligonucleotide
taatatattcgcggcgactgaccag

SEQ ID NO: 729773 - DNA, 25 bp, Artificial sequence
  Synthetic oligonucleotide
gtttacacgcgccaactatgcgaaa

SEQ ID NO: 729774 - DNA, 25 bp, Artificial sequence
  Synthetic oligonucleotide
aggattggttcgtaccgtaacgatg

SEQ ID NO: 729775 - DNA, 25 bp, Artificial sequence
  Synthetic oligonucleotide
gaatgccggtaaggtcgtacatcta

SEQ ID NO: 729776 - DNA, 25 bp, Artificial sequence
  Synthetic oligonucleotide
gaatgccggtaacgtcgtacatcta

SEQ ID NO: 729777 - DNA, 25 bp, Artificial sequence
  Synthetic oligonucleotide
agattaatcccggtcgatcctgcta

SEQ ID NO: 729778 - DNA, 25 bp, Artificial sequence
  Synthetic oligonucleotide
agattaatcccgctcgatcctgcta

SEQ ID NO: 729779 - DNA, 25 bp, Artificial sequence
  Synthetic oligonucleotide
gactgctataatcgacccgtctgaa

SEQ ID NO: 729780 - DNA, 25 bp, Artificial sequence
  Synthetic oligonucleotide
gcaactggtatttacgccgtatggt

SEQ ID NO: 729781 - DNA, 25 bp, Artificial sequence
  Synthetic oligonucleotide
aggattggttcgaaccgtaacgatg

SEQ ID NO: 729782 - DNA, 25 bp, Artificial sequence
  Synthetic oligonucleotide
acactctcgtacgtcggctgaatat

SEQ ID NO: 729783 - DNA, 25 bp, Artificial sequence
  Synthetic oligonucleotide
agatcacgcgccgtaatgatgtcta

SEQ ID NO: 729784 - DNA, 25 bp, Artificial sequence
  Synthetic oligonucleotide
agatcacgcgccctaatgatgtcta

SEQ ID NO: 729785 - DNA, 25 bp, Artificial sequence
  Synthetic oligonucleotide
cagttacgctcgtcgtatgttgtca

SEQ ID NO: 729786 - DNA, 25 bp, Artificial sequence
  Synthetic oligonucleotide
cagttacgctcgacgtatgttgtca

SEQ ID NO: 729787 - DNA, 25 bp, Artificial sequence
  Synthetic oligonucleotide
ttgagatcacgacgcgatattctcc

SEQ ID NO: 729788 - DNA, 25 bp, Artificial sequence
  Synthetic oligonucleotide
ttgagatcacgaggcgatattctcc

SEQ ID NO: 729789 - DNA, 25 bp, Artificial sequence
  Synthetic oligonucleotide
gactgctataatggacccgtctgaa

SEQ ID NO: 729790 - DNA, 25 bp, Artificial sequence
  Synthetic oligonucleotide
ctatagacgtcgaatcggtccacat

SEQ ID NO: 729791 - DNA, 25 bp, Artificial sequence
  Synthetic oligonucleotide
cagacagtaacggacgtactttgtg

SEQ ID NO: 729792 - DNA, 25 bp, Artificial sequence
  Synthetic oligonucleotide
tacttaagtcgccaacattcgccgt

SEQ ID NO: 729793 - DNA, 25 bp, Artificial sequence
  Synthetic oligonucleotide
taccagcgcgatatgtacgtacgat

SEQ ID NO: 729794 - DNA, 25 bp, Artificial sequence
  Synthetic oligonucleotide
taccagcgcgatttgtacgtacgat

SEQ ID NO: 729795 - DNA, 25 bp, Artificial sequence
  Synthetic oligonucleotide
tggacttcgcgtggtaatgccaaat

SEQ ID NO: 729796 - DNA, 25 bp, Artificial sequence
  Synthetic oligonucleotide
ccgaaacgcataggttcgaatatgg

SEQ ID NO: 729797 - DNA, 25 bp, Artificial sequence
  Synthetic oligonucleotide
ctatagacgtcgtatcggtccacat

SEQ ID NO: 729798 - DNA, 25 bp, Artificial sequence
  Synthetic oligonucleotide
ccgaaacgcatacgttcgaatatgg

SEQ ID NO: 729799 - DNA, 25 bp, Artificial sequence
  Synthetic oligonucleotide
gacgttgtcctacgcgaatttctct

SEQ ID NO: 729800 - DNA, 25 bp, Artificial sequence
  Synthetic oligonucleotide
gacgttgtcctaggcgaatttctct

SEQ ID NO: 729801 - DNA, 25 bp, Artificial sequence
  Synthetic oligonucleotide
caagtggttacgttcggtcagttag

SEQ ID NO: 729802 - DNA, 25 bp, Artificial sequence
  Synthetic oligonucleotide
caagtggttacgatcggtcagttag

SEQ ID NO: 729803 - DNA, 25 bp, Artificial sequence
  Synthetic oligonucleotide
cgaattcgctcgaatagtgtatcgg

SEQ ID NO: 729804 - DNA, 25 bp, Artificial sequence
  Synthetic oligonucleotide
gtaactttaacgcgcgtactgtcac

SEQ ID NO: 729805 - DNA, 25 bp, Artificial sequence
  Synthetic oligonucleotide
tggacttcgcgtcgtaatgccaaat

SEQ ID NO: 729806 - DNA, 25 bp, Artificial sequence
  Synthetic oligonucleotide
gagggattcggccgtacgataattt

SEQ ID NO: 729807 - DNA, 25 bp, Artificial sequence
  Synthetic oligonucleotide
gtctatcgtacgccactatatgtgc

SEQ ID NO: 729808 - DNA, 25 bp, Artificial sequence
  Synthetic oligonucleotide
gtctatcgtacggcactatatgtgc

SEQ ID NO: 729809 - DNA, 25 bp, Artificial sequence
  Synthetic oligonucleotide
cgctaatatcgcctacgttttccga

SEQ ID NO: 729810 - DNA, 25 bp, Artificial sequence
  Synthetic oligonucleotide
cgctaatatcgcgtacgttttccga

SEQ ID NO: 729811 - DNA, 25 bp, Artificial sequence
  Synthetic oligonucleotide
agactgtacgaccgtgtcgataatg

SEQ ID NO: 729812 - DNA, 25 bp, Artificial sequence
  Synthetic oligonucleotide
tacttaagtcgcgaacattcgccgt

SEQ ID NO: 729813 - DNA, 25 bp, Artificial sequence
  Synthetic oligonucleotide
gagggattcggcggtacgataattt

SEQ ID NO: 729814 - DNA, 25 bp, Artificial sequence
  Synthetic oligonucleotide
cagacagtaacgcacgtactttgtg

SEQ ID NO: 729815 - DNA, 25 bp, Artificial sequence
  Synthetic oligonucleotide
gtggtatatacgaccgacaaagcca

SEQ ID NO: 729816 - DNA, 25 bp, Artificial sequence
  Synthetic oligonucleotide
gtggtatatacgtccgacaaagcca

SEQ ID NO: 729817 - DNA, 25 bp, Artificial sequence
  Synthetic oligonucleotide
ttgcaggactatacgacgcttagga

SEQ ID NO: 729818 - DNA, 25 bp, Artificial sequence
  Synthetic oligonucleotide
ttgcaggactattcgacgcttagga

SEQ ID NO: 729819 - DNA, 25 bp, Artificial sequence
  Synthetic oligonucleotide
cgaatacaatcgcgtagcgtatgct

SEQ ID NO: 729820 - DNA, 25 bp, Artificial sequence
  Synthetic oligonucleotide
cgaatacaatcgggtagcgtatgct

SEQ ID NO: 729821 - DNA, 25 bp, Artificial sequence
  Synthetic oligonucleotide
agactgtacgacggtgtcgataatg

SEQ ID NO: 729822 - DNA, 25 bp, Artificial sequence
  Synthetic oligonucleotide
ggtgttcgaatatacggcgaacgaa

SEQ ID NO: 729823 - DNA, 25 bp, Artificial sequence
  Synthetic oligonucleotide
cgaattcgctcgtatagtgtatcgg

SEQ ID NO: 729824 - DNA, 25 bp, Artificial sequence
  Synthetic oligonucleotide
acccctgatcgaggttacactaaac

SEQ ID NO: 729825 - DNA, 25 bp, Artificial sequence
  Synthetic oligonucleotide
aagctgacacccgtcgatactaagt

SEQ ID NO: 729826 - DNA, 25 bp, Artificial sequence
  Synthetic oligonucleotide
cctatagaccgtctagcgttgatgt

SEQ ID NO: 729827 - DNA, 25 bp, Artificial sequence
  Synthetic oligonucleotide
agaatgttagggagacgcgtctatc

SEQ ID NO: 729828 - DNA, 25 bp, Artificial sequence
  Synthetic oligonucleotide
gagagagggtattccgtcgataaca

SEQ ID NO: 729829 - DNA, 25 bp, Artificial sequence
  Synthetic oligonucleotide
ggtgttcgaataaacggcgaacgaa

SEQ ID NO: 729830 - DNA, 25 bp, Artificial sequence
  Synthetic oligonucleotide
gagagagggtataccgtcgataaca

SEQ ID NO: 729831 - DNA, 25 bp, Artificial sequence
  Synthetic oligonucleotide
attcacagtcgttccgtagcagcaa

SEQ ID NO: 729832 - DNA, 25 bp, Artificial sequence
  Synthetic oligonucleotide
attcacagtcgtaccgtagcagcaa

SEQ ID NO: 729833 - DNA, 25 bp, Artificial sequence
  Synthetic oligonucleotide
aaaatatagcgcccaacgaccttcc

SEQ ID NO: 729834 - DNA, 25 bp, Artificial sequence
  Synthetic oligonucleotide
aaaatatagcgcgcaacgaccttcc

SEQ ID NO: 729835 - DNA, 25 bp, Artificial sequence
  Synthetic oligonucleotide
agcttagtacaagcggtcgctttct

SEQ ID NO: 729836 - DNA, 25 bp, Artificial sequence
  Synthetic oligonucleotide
agcttagtacaaccggtcgctttct

SEQ ID NO: 729837 - DNA, 25 bp, Artificial sequence
  Synthetic oligonucleotide
agaatgttagggtgacgcgtctatc

SEQ ID NO: 729838 - DNA, 25 bp, Artificial sequence
  Synthetic oligonucleotide
acttgttcgcgtaacggatcgaact

SEQ ID NO: 729839 - DNA, 25 bp, Artificial sequence
  Synthetic oligonucleotide
tggagctgcgtaagtcgacaaatga

SEQ ID NO: 729840 - DNA, 25 bp, Artificial sequence
  Synthetic oligonucleotide
tggagctgcgtatgtcgacaaatga

SEQ ID NO: 729841 - DNA, 25 bp, Artificial sequence
  Synthetic oligonucleotide
gtacgtcgttcgacgaactctgttt

SEQ ID NO: 729842 - DNA, 25 bp, Artificial sequence
  Synthetic oligonucleotide
gtacgtcgttcgtcgaactctgttt

SEQ ID NO: 729843 - DNA, 25 bp, Artificial sequence
  Synthetic oligonucleotide
tactcggtacgaaagacgcgttatg

SEQ ID NO: 729844 - DNA, 25 bp, Artificial sequence
  Synthetic oligonucleotide
gactaacgatacgcaaggtttccac

SEQ ID NO: 729845 - DNA, 25 bp, Artificial sequence
  Synthetic oligonucleotide
acttgttcgcgttacggatcgaact

SEQ ID NO: 729846 - DNA, 25 bp, Artificial sequence
  Synthetic oligonucleotide
cctatagaccgtgtagcgttgatgt

SEQ ID NO: 729847 - DNA, 25 bp, Artificial sequence
  Synthetic oligonucleotide
agagtctaagacctcgcgaattgtg

SEQ ID NO: 729848 - DNA, 25 bp, Artificial sequence
  Synthetic oligonucleotide
agagtctaagacgtcgcgaattgtg

SEQ ID NO: 729849 - DNA, 25 bp, Artificial sequence
  Synthetic oligonucleotide
tgacctacgcatggcgtaatgaaga

SEQ ID NO: 729850 - DNA, 25 bp, Artificial sequence
  Synthetic oligonucleotide
tgacctacgcatcgcgtaatgaaga

SEQ ID NO: 729851 - DNA, 25 bp, Artificial sequence
  Synthetic oligonucleotide
tagttttcgcaaccgacccagaaac

SEQ ID NO: 729852 - DNA, 25 bp, Artificial sequence
  Synthetic oligonucleotide
tagttttcgcaagcgacccagaaac

SEQ ID NO: 729853 - DNA, 25 bp, Artificial sequence
  Synthetic oligonucleotide
tactcggtacgatagacgcgttatg

SEQ ID NO: 729854 - DNA, 25 bp, Artificial sequence
  Synthetic oligonucleotide
tgcttctcggcgcgatttaatacac

SEQ ID NO: 729855 - DNA, 25 bp, Artificial sequence
  Synthetic oligonucleotide
ttgccctacggcgtagtacctatat

SEQ ID NO: 729856 - DNA, 25 bp, Artificial sequence
  Synthetic oligonucleotide
gaggtattacgcgtagggaagaagt

SEQ ID NO: 729857 - DNA, 25 bp, Artificial sequence
  Synthetic oligonucleotide
gaggtattacgcctagggaagaagt

SEQ ID NO: 729858 - DNA, 25 bp, Artificial sequence
  Synthetic oligonucleotide
gcgtaactattagtcgcgggaagtt

SEQ ID NO: 729859 - DNA, 25 bp, Artificial sequence
  Synthetic oligonucleotide
gcgtaactattactcgcgggaagtt

SEQ ID NO: 729860 - DNA, 25 bp, Artificial sequence
  Synthetic oligonucleotide
tgtacttaacggatcgcgtcaagtg

SEQ ID NO: 729861 - DNA, 25 bp, Artificial sequence
  Synthetic oligonucleotide
atagagcgctagatcgcccttgaaa

SEQ ID NO: 729862 - DNA, 25 bp, Artificial sequence
  Synthetic oligonucleotide
gaaagaactacgatacgccaacctg

SEQ ID NO: 729863 - DNA, 25 bp, Artificial sequence
  Synthetic oligonucleotide
tgcttctcggcgggatttaatacac

SEQ ID NO: 729864 - DNA, 25 bp, Artificial sequence
  Synthetic oligonucleotide
cgagtttgtatccgaccgcttgtat

SEQ ID NO: 729865 - DNA, 25 bp, Artificial sequence
  Synthetic oligonucleotide
cgagtttgtatcggaccgcttgtat

SEQ ID NO: 729866 - DNA, 25 bp, Artificial sequence
  Synthetic oligonucleotide
cacgaagacgccctacttatgaact

SEQ ID NO: 729867 - DNA, 25 bp, Artificial sequence
  Synthetic oligonucleotide
cacgaagacgccgtacttatgaact

SEQ ID NO: 729868 - DNA, 25 bp, Artificial sequence
  Synthetic oligonucleotide
ttacaatatcgcgcatcgttcgacg

SEQ ID NO: 729869 - DNA, 25 bp, Artificial sequence
  Synthetic oligonucleotide
atagagcgctagttcgcccttgaaa

SEQ ID NO: 729870 - DNA, 25 bp, Artificial sequence
  Synthetic oligonucleotide
caaaatcgtcgtataaggccgagac

SEQ ID NO: 729871 - DNA, 25 bp, Artificial sequence
  Synthetic oligonucleotide
ttgccctacggcctagtacctatat

SEQ ID NO: 729872 - DNA, 25 bp, Artificial sequence
  Synthetic oligonucleotide
tgtgtagcgagactatcgtctttgg

SEQ ID NO: 729873 - DNA, 25 bp, Artificial sequence
  Synthetic oligonucleotide
tgtgtagcgagagtatcgtctttgg

SEQ ID NO: 729874 - DNA, 25 bp, Artificial sequence
  Synthetic oligonucleotide
cttttggaaatttcgcgcgagatcg

SEQ ID NO: 729875 - DNA, 25 bp, Artificial sequence
  Synthetic oligonucleotide
cttttggaaattacgcgcgagatcg

SEQ ID NO: 729876 - DNA, 25 bp, Artificial sequence
  Synthetic oligonucleotide
tgtacttaacggttcgcgtcaagtg

SEQ ID NO: 729877 - DNA, 25 bp, Artificial sequence
  Synthetic oligonucleotide
gttactcgtaacacgacgtggcaaa

SEQ ID NO: 729878 - DNA, 25 bp, Artificial sequence
  Synthetic oligonucleotide
atacgattcgcgcatggataacgtg

SEQ ID NO: 729879 - DNA, 25 bp, Artificial sequence
  Synthetic oligonucleotide
caaaatcgtcgtttaaggccgagac

SEQ ID NO: 729880 - DNA, 25 bp, Artificial sequence
  Synthetic oligonucleotide
tgtgtcgtcgtatcgtacgtttcct

SEQ ID NO: 729881 - DNA, 25 bp, Artificial sequence
  Synthetic oligonucleotide
tgtgtcgtcgtaacgtacgtttcct

SEQ ID NO: 729882 - DNA, 25 bp, Artificial sequence
  Synthetic oligonucleotide
ctcggtgcgtaaacgactaacatct

SEQ ID NO: 729883 - DNA, 25 bp, Artificial sequence
  Synthetic oligonucleotide
ctcggtgcgtaatcgactaacatct

SEQ ID NO: 729884 - DNA, 25 bp, Artificial sequence
  Synthetic oligonucleotide
gaaagaactacgttacgccaacctg

SEQ ID NO: 729885 - DNA, 25 bp, Artificial sequence
  Synthetic oligonucleotide
gttactcgtaactcgacgtggcaaa

SEQ ID NO: 729886 - DNA, 25 bp, Artificial sequence
  Synthetic oligonucleotide
tcctcgcgcgattctaagttacaac

SEQ ID NO: 729887 - DNA, 25 bp, Artificial sequence
  Synthetic oligonucleotide
gcgtaacgcctaacgtacagtctaa

SEQ ID NO: 729888 - DNA, 25 bp, Artificial sequence
  Synthetic oligonucleotide
gcgtaacgcctatcgtacagtctaa

SEQ ID NO: 729889 - DNA, 25 bp, Artificial sequence
  Synthetic oligonucleotide
tcggaaccgtagtccgatagactta

SEQ ID NO: 729890 - DNA, 25 bp, Artificial sequence
  Synthetic oligonucleotide
tcggaaccgtagaccgatagactta

SEQ ID NO: 729891 - DNA, 25 bp, Artificial sequence
  Synthetic oligonucleotide
gaaatcctagtcccgacgtggttta

SEQ ID NO: 729892 - DNA, 25 bp, Artificial sequence
  Synthetic oligonucleotide
ttacaatatcgcccatcgttcgacg

SEQ ID NO: 729893 - DNA, 25 bp, Artificial sequence
  Synthetic oligonucleotide
tcctcgcgcgatactaagttacaac

SEQ ID NO: 729894 - DNA, 25 bp, Artificial sequence
  Synthetic oligonucleotide
ttgcttcgctacaggcgtactagta

SEQ ID NO: 729895 - DNA, 25 bp, Artificial sequence
  Synthetic oligonucleotide
attagtgtaataggtcgcgaccacc

SEQ ID NO: 729896 - DNA, 25 bp, Artificial sequence
  Synthetic oligonucleotide
attagtgtaatacgtcgcgaccacc

SEQ ID NO: 729897 - DNA, 25 bp, Artificial sequence
  Synthetic oligonucleotide
ataactcgtacgtgcgataagtccg

SEQ ID NO: 729898 - DNA, 25 bp, Artificial sequence
  Synthetic oligonucleotide
ataactcgtacgagcgataagtccg

SEQ ID NO: 729899 - DNA, 25 bp, Artificial sequence
  Synthetic oligonucleotide
atagcatagcgctacgagacatggt

SEQ ID NO: 729900 - DNA, 25 bp, Artificial sequence
  Synthetic oligonucleotide
acccctgatcgacgttacactaaac

SEQ ID NO: 729901 - DNA, 25 bp, Artificial sequence
  Synthetic oligonucleotide
gaaatcctagtcgcgacgtggttta

SEQ ID NO: 729902 - DNA, 25 bp, Artificial sequence
  Synthetic oligonucleotide
cgagccgtacgaacgtatgattgaa

SEQ ID NO: 729903 - DNA, 25 bp, Artificial sequence
  Synthetic oligonucleotide
gtccaacgttcgacggtatactcat

SEQ ID NO: 729904 - DNA, 25 bp, Artificial sequence
  Synthetic oligonucleotide
gtccaacgttcgtcggtatactcat

SEQ ID NO: 729905 - DNA, 25 bp, Artificial sequence
  Synthetic oligonucleotide
atgtttgtctcgggttaaggaccgt

SEQ ID NO: 729906 - DNA, 25 bp, Artificial sequence
  Synthetic oligonucleotide
tcagtggtccggggtataagttaca

SEQ ID NO: 729907 - DNA, 25 bp, Artificial sequence
  Synthetic oligonucleotide
tcagtggtccggcgtataagttaca

SEQ ID NO: 729908 - DNA, 25 bp, Artificial sequence
  Synthetic oligonucleotide
cgacaactcgtatcgggtataactc

SEQ ID NO: 729909 - DNA, 25 bp, Artificial sequence
  Synthetic oligonucleotide
gtgaaacgactaggctttagactgg

SEQ ID NO: 729910 - DNA, 25 bp, Artificial sequence
  Synthetic oligonucleotide
cgagccgtacgatcgtatgattgaa

SEQ ID NO: 729911 - DNA, 25 bp, Artificial sequence
  Synthetic oligonucleotide
gtgaaacgactacgctttagactgg

SEQ ID NO: 729912 - DNA, 25 bp, Artificial sequence
  Synthetic oligonucleotide
atactgtactcgtcggtcgaacact

SEQ ID NO: 729913 - DNA, 25 bp, Artificial sequence
  Synthetic oligonucleotide
atactgtactcgacggtcgaacact

SEQ ID NO: 729914 - DNA, 25 bp, Artificial sequence
  Synthetic oligonucleotide
taggaatacgtcgttagactggtcg

SEQ ID NO: 729915 - DNA, 25 bp, Artificial sequence
  Synthetic oligonucleotide
taggaatacgtccttagactggtcg

SEQ ID NO: 729916 - DNA, 25 bp, Artificial sequence
  Synthetic oligonucleotide
ttgcttcgctactggcgtactagta

SEQ ID NO: 729917 - DNA, 25 bp, Artificial sequence
  Synthetic oligonucleotide
atacgattcgcggatggataacgtg

SEQ ID NO: 729918 - DNA, 25 bp, Artificial sequence
  Synthetic oligonucleotide
cgacaactcgtaacgggtataactc

SEQ ID NO: 729919 - DNA, 25 bp, Artificial sequence
  Synthetic oligonucleotide
ccatatcgcgcgtatcaacacaaca

SEQ ID NO: 729920 - DNA, 25 bp, Artificial sequence
  Synthetic oligonucleotide
taacttcgcatcgcgtagtcttagg

SEQ ID NO: 729921 - DNA, 25 bp, Artificial sequence
  Synthetic oligonucleotide
tcgcagtcgtaagggactaccttaa

SEQ ID NO: 729922 - DNA, 25 bp, Artificial sequence
  Synthetic oligonucleotide
aattcgccgtagggcattactacct

SEQ ID NO: 729923 - DNA, 25 bp, Artificial sequence
  Synthetic oligonucleotide
aattcgccgtagcgcattactacct

SEQ ID NO: 729924 - DNA, 25 bp, Artificial sequence
  Synthetic oligonucleotide
catcacgttctaaccgcgatcatga

SEQ ID NO: 729925 - DNA, 25 bp, Artificial sequence
  Synthetic oligonucleotide
tccgatgtcgcgttaatacccacat

SEQ ID NO: 729926 - DNA, 25 bp, Artificial sequence
  Synthetic oligonucleotide
ccatatcgcgcgaatcaacacaaca

SEQ ID NO: 729927 - DNA, 25 bp, Artificial sequence
  Synthetic oligonucleotide
tccgatgtcgcgataatacccacat

SEQ ID NO: 729928 - DNA, 25 bp, Artificial sequence
  Synthetic oligonucleotide
cattctacgtcgtaccatctatggc

SEQ ID NO: 729929 - DNA, 25 bp, Artificial sequence
  Synthetic oligonucleotide
cattctacgtcgaaccatctatggc

SEQ ID NO: 729930 - DNA, 25 bp, Artificial sequence
  Synthetic oligonucleotide
gctgttaagcgatcgacgtcataac

SEQ ID NO: 729931 - DNA, 25 bp, Artificial sequence
  Synthetic oligonucleotide
gctgttaagcgaacgacgtcataac

SEQ ID NO: 729932 - DNA, 25 bp, Artificial sequence
  Synthetic oligonucleotide
ttttcacgaaccccgagtaatctgg

SEQ ID NO: 729933 - DNA, 25 bp, Artificial sequence
  Synthetic oligonucleotide
ttttcacgaaccgcgagtaatctgg

SEQ ID NO: 729934 - DNA, 25 bp, Artificial sequence
  Synthetic oligonucleotide
catcacgttctatccgcgatcatga

SEQ ID NO: 729935 - DNA, 25 bp, Artificial sequence
  Synthetic oligonucleotide
gttcttgcgtcgaatacgaaaggca

SEQ ID NO: 729936 - DNA, 25 bp, Artificial sequence
  Synthetic oligonucleotide
caatgctagccgtcgctaaattctg

SEQ ID NO: 729937 - DNA, 25 bp, Artificial sequence
  Synthetic oligonucleotide
caatgctagccgacgctaaattctg

SEQ ID NO: 729938 - DNA, 25 bp, Artificial sequence
  Synthetic oligonucleotide
ccttaggtacgttacgcgtgacata

SEQ ID NO: 729939 - DNA, 25 bp, Artificial sequence
  Synthetic oligonucleotide
ccttaggtacgtaacgcgtgacata

SEQ ID NO: 729940 - DNA, 25 bp, Artificial sequence
  Synthetic oligonucleotide
aggcagcggtcgcgttatatatgaa

SEQ ID NO: 729941 - DNA, 25 bp, Artificial sequence
  Synthetic oligonucleotide
tcgcagtcgtaacggactaccttaa

SEQ ID NO: 729942 - DNA, 25 bp, Artificial sequence
  Synthetic oligonucleotide
gttcttgcgtcgtatacgaaaggca

SEQ ID NO: 729943 - DNA, 25 bp, Artificial sequence
  Synthetic oligonucleotide
tgaacaggttacgcgtaacctgcat

SEQ ID NO: 729944 - DNA, 25 bp, Artificial sequence
  Synthetic oligonucleotide
atgtttgtctcgcgttaaggaccgt

SEQ ID NO: 729945 - DNA, 25 bp, Artificial sequence
  Synthetic oligonucleotide
ttgcatccgcacaacgtacagttct

SEQ ID NO: 729946 - DNA, 25 bp, Artificial sequence
  Synthetic oligonucleotide
atcctgtcggacttacgtctagatg

SEQ ID NO: 729947 - DNA, 25 bp, Artificial sequence
  Synthetic oligonucleotide
tgaacaggttacccgtaacctgcat

SEQ ID NO: 729948 - DNA, 25 bp, Artificial sequence
  Synthetic oligonucleotide
gaacagagaacgggacgtacaattc

SEQ ID NO: 729949 - DNA, 25 bp, Artificial sequence
  Synthetic oligonucleotide
gaacagagaacgcgacgtacaattc

SEQ ID NO: 729950 - DNA, 25 bp, Artificial sequence
  Synthetic oligonucleotide
aggcagcggtcgggttatatatgaa

SEQ ID NO: 729951 - DNA, 25 bp, Artificial sequence
  Synthetic oligonucleotide
tgtgtagactatcttcgcgcgacat

SEQ ID NO: 729952 - DNA, 25 bp, Artificial sequence
  Synthetic oligonucleotide
tcgaaacgacggacgtcaaacaagt

SEQ ID NO: 729953 - DNA, 25 bp, Artificial sequence
  Synthetic oligonucleotide
tcgaaacgacggtcgtcaaacaagt

SEQ ID NO: 729954 - DNA, 25 bp, Artificial sequence
  Synthetic oligonucleotide
accagagagcgtcgacaatatcagt

SEQ ID NO: 729955 - DNA, 25 bp, Artificial sequence
  Synthetic oligonucleotide
cctactcgtatcgacacgataggta

SEQ ID NO: 729956 - DNA, 25 bp, Artificial sequence
  Synthetic oligonucleotide
taggttcgcgtcctaccttttgtct

SEQ ID NO: 729957 - DNA, 25 bp, Artificial sequence
  Synthetic oligonucleotide
taggttcgcgtcgtaccttttgtct

SEQ ID NO: 729958 - DNA, 25 bp, Artificial sequence
  Synthetic oligonucleotide
acacgtgtagcgattcgcgaataac

SEQ ID NO: 729959 - DNA, 25 bp, Artificial sequence
  Synthetic oligonucleotide
cctaaacgatacggtcgtatcatcg

SEQ ID NO: 729960 - DNA, 25 bp, Artificial sequence
  Synthetic oligonucleotide
accagagagcgtggacaatatcagt

SEQ ID NO: 729961 - DNA, 25 bp, Artificial sequence
  Synthetic oligonucleotide
tgtgtagactatgttcgcgcgacat

SEQ ID NO: 729962 - DNA, 25 bp, Artificial sequence
  Synthetic oligonucleotide
taagtctacgcccaaacgctcatga

SEQ ID NO: 729963 - DNA, 25 bp, Artificial sequence
  Synthetic oligonucleotide
taagtctacgccgaaacgctcatga

SEQ ID NO: 729964 - DNA, 25 bp, Artificial sequence
  Synthetic oligonucleotide
atcctgtcggacatacgtctagatg

SEQ ID NO: 729965 - DNA, 25 bp, Artificial sequence
  Synthetic oligonucleotide
taacttcgcatcccgtagtcttagg

SEQ ID NO: 729966 - DNA, 25 bp, Artificial sequence
  Synthetic oligonucleotide
ttgcatccgcactacgtacagttct

SEQ ID NO: 729967 - DNA, 25 bp, Artificial sequence
  Synthetic oligonucleotide
cctaaacgataccgtcgtatcatcg

SEQ ID NO: 729968 - DNA, 25 bp, Artificial sequence
  Synthetic oligonucleotide
gatagaatacgtgacgcggctactt

SEQ ID NO: 729969 - DNA, 25 bp, Artificial sequence
  Synthetic oligonucleotide
aagtccctagtagacgcgagagtat

SEQ ID NO: 729970 - DNA, 25 bp, Artificial sequence
  Synthetic oligonucleotide
aagtccctagtacacgcgagagtat

SEQ ID NO: 729971 - DNA, 25 bp, Artificial sequence
  Synthetic oligonucleotide
cctactcgtatccacacgataggta

SEQ ID NO: 729972 - DNA, 25 bp, Artificial sequence
  Synthetic oligonucleotide
gatagaatacgtcacgcggctactt

SEQ ID NO: 729973 - DNA, 25 bp, Artificial sequence
  Synthetic oligonucleotide
acacgtgtagcgtttcgcgaataac

SEQ ID NO: 729974 - DNA, 25 bp, Artificial sequence
  Synthetic oligonucleotide
catcatcttatcccgttgatacgcc

SEQ ID NO: 729975 - DNA, 25 bp, Artificial sequence
  Synthetic oligonucleotide
catcatcttatcgcgttgatacgcc

SEQ ID NO: 729976 - DNA, 25 bp, Artificial sequence
  Synthetic oligonucleotide
tattttcgtaccgaagcgtggcaga

SEQ ID NO: 729977 - DNA, 25 bp, Artificial sequence
  Synthetic oligonucleotide
tattttcgtacccaagcgtggcaga

SEQ ID NO: 729978 - DNA, 25 bp, Artificial sequence
  Synthetic oligonucleotide
atcgcccgataccgtacgtttatag

SEQ ID NO: 729979 - DNA, 25 bp, Artificial sequence
  Synthetic oligonucleotide
atcgcccgatacggtacgtttatag

SEQ ID NO: 729980 - DNA, 25 bp, Artificial sequence
  Synthetic oligonucleotide
gtattctaccggtcgactgtgcaaa

SEQ ID NO: 729981 - DNA, 25 bp, Artificial sequence
  Synthetic oligonucleotide
gtattctaccggacgactgtgcaaa

SEQ ID NO: 729982 - DNA, 25 bp, Artificial sequence
  Synthetic oligonucleotide
accgcacctcgacacgtattttcca

SEQ ID NO: 729983 - DNA, 25 bp, Artificial sequence
  Synthetic oligonucleotide
ctcgaggtcgcgaccttaacttgtt

SEQ ID NO: 729984 - DNA, 25 bp, Artificial sequence
  Synthetic oligonucleotide
taaaggataccccgacgcttccaga

SEQ ID NO: 729985 - DNA, 25 bp, Artificial sequence
  Synthetic oligonucleotide
gtgaagccgttaaagtacgggtcag

SEQ ID NO: 729986 - DNA, 25 bp, Artificial sequence
  Synthetic oligonucleotide
taaaggatacccggacgcttccaga

SEQ ID NO: 729987 - DNA, 25 bp, Artificial sequence
  Synthetic oligonucleotide
tcattcgccttatcgcgatcatcgc

SEQ ID NO: 729988 - DNA, 25 bp, Artificial sequence
  Synthetic oligonucleotide
tcattcgccttaacgcgatcatcgc

SEQ ID NO: 729989 - DNA, 25 bp, Artificial sequence
  Synthetic oligonucleotide
gtgatgagtacttcggtcgtccatg

SEQ ID NO: 729990 - DNA, 25 bp, Artificial sequence
  Synthetic oligonucleotide
aagtatacgcgccgcatactcccat

SEQ ID NO: 729991 - DNA, 25 bp, Artificial sequence
  Synthetic oligonucleotide
gtgaagccgttatagtacgggtcag

SEQ ID NO: 729992 - DNA, 25 bp, Artificial sequence
  Synthetic oligonucleotide
accgcacctcgagacgtattttcca

SEQ ID NO: 729993 - DNA, 25 bp, Artificial sequence
  Synthetic oligonucleotide
tcgtcaagcgagaatcgcgtaagtc

SEQ ID NO: 729994 - DNA, 25 bp, Artificial sequence
  Synthetic oligonucleotide
tcgtcaagcgagtatcgcgtaagtc

SEQ ID NO: 729995 - DNA, 25 bp, Artificial sequence
  Synthetic oligonucleotide
gtgtctataccgctacgcgagctaa

SEQ ID NO: 729996 - DNA, 25 bp, Artificial sequence
  Synthetic oligonucleotide
gtgtctataccggtacgcgagctaa

SEQ ID NO: 729997 - DNA, 25 bp, Artificial sequence
  Synthetic oligonucleotide
cgttatatacgcccgatacacgcca

SEQ ID NO: 729998 - DNA, 25 bp, Artificial sequence
  Synthetic oligonucleotide
cgttatatacgcgcgatacacgcca

SEQ ID NO: 729999 - DNA, 25 bp, Artificial sequence
  Synthetic oligonucleotide
aagtatacgcgcggcatactcccat

SEQ ID NO: 730000 - DNA, 25 bp, Artificial sequence
  Synthetic oligonucleotide
acaacaccatatgcggacgaggatg

SEQ ID NO: 730001 - DNA, 25 bp, Artificial sequence
  Synthetic oligonucleotide
gtgatgagtactacggtcgtccatg

SEQ ID NO: 730002 - DNA, 25 bp, Artificial sequence
  Synthetic oligonucleotide
cacttccgatattgcgccttacgga

SEQ ID NO: 730003 - DNA, 25 bp, Artificial sequence
  Synthetic oligonucleotide
ggccaggcgtataacggccataaaa

SEQ ID NO: 730004 - DNA, 25 bp, Artificial sequence
  Synthetic oligonucleotide
agaacgaatagcccgcgtagacgaa

SEQ ID NO: 730005 - DNA, 25 bp, Artificial sequence
  Synthetic oligonucleotide
ggccaggcgtattacggccataaaa

SEQ ID NO: 730006 - DNA, 25 bp, Artificial sequence
  Synthetic oligonucleotide
ctggttcgagcgtagtacgtgattc

SEQ ID NO: 730007 - DNA, 25 bp, Artificial sequence
  Synthetic oligonucleotide
tgggagtaagtcacgtccgagatct

SEQ ID NO: 730008 - DNA, 25 bp, Artificial sequence
  Synthetic oligonucleotide
ctggttcgagcgaagtacgtgattc

SEQ ID NO: 730009 - DNA, 25 bp, Artificial sequence
  Synthetic oligonucleotide
tgggagtaagtctcgtccgagatct

SEQ ID NO: 730010 - DNA, 25 bp, Artificial sequence
  Synthetic oligonucleotide
ttagtttcgcgaaaaccgccgctac

SEQ ID NO: 730011 - DNA, 25 bp, Artificial sequence
  Synthetic oligonucleotide
ttagtttcgcgataaccgccgctac

SEQ ID NO: 730012 - DNA, 25 bp, Artificial sequence
  Synthetic oligonucleotide
gtatttacgtcggacgactgctacg

SEQ ID NO: 730013 - DNA, 25 bp, Artificial sequence
  Synthetic oligonucleotide
gtatttacgtcgcacgactgctacg

SEQ ID NO: 730014 - DNA, 25 bp, Artificial sequence
  Synthetic oligonucleotide
cttttatcacgacggtacgcgttgc

SEQ ID NO: 730015 - DNA, 25 bp, Artificial sequence
  Synthetic oligonucleotide
ctcgaggtcgcgtccttaacttgtt

SEQ ID NO: 730016 - DNA, 25 bp, Artificial sequence
  Synthetic oligonucleotide
cttttatcacgagggtacgcgttgc

SEQ ID NO: 730017 - DNA, 25 bp, Artificial sequence
  Synthetic oligonucleotide
acaacaccatatccggacgaggatg

SEQ ID NO: 730018 - DNA, 25 bp, Artificial sequence
  Synthetic oligonucleotide
tttgaagtagattgcgacggccgga

SEQ ID NO: 730019 - DNA, 25 bp, Artificial sequence
  Synthetic oligonucleotide
agcaatcgacgtatcccgtatacgc

SEQ ID NO: 730020 - DNA, 25 bp, Artificial sequence
  Synthetic oligonucleotide
agtaagcgatcccgtatatagcgcg

SEQ ID NO: 730021 - DNA, 25 bp, Artificial sequence
  Synthetic oligonucleotide
aatcgttcggtgggacggtttcaga

SEQ ID NO: 730022 - DNA, 25 bp, Artificial sequence
  Synthetic oligonucleotide
aatcgttcggtgcgacggtttcaga

SEQ ID NO: 730023 - DNA, 25 bp, Artificial sequence
  Synthetic oligonucleotide
tttcggcgtatacgacgcgcgtatt

SEQ ID NO: 730024 - DNA, 25 bp, Artificial sequence
  Synthetic oligonucleotide
tttcggcgtataggacgcgcgtatt

SEQ ID NO: 730025 - DNA, 25 bp, Artificial sequence
  Synthetic oligonucleotide
tcctcaagcgcgattgtcgtactca

SEQ ID NO: 730026 - DNA, 25 bp, Artificial sequence
  Synthetic oligonucleotide
ttcacggtttgatcgcgcgttgtac

SEQ ID NO: 730027 - DNA, 25 bp, Artificial sequence
  Synthetic oligonucleotide
tcctcaagcgcgtttgtcgtactca

SEQ ID NO: 730028 - DNA, 25 bp, Artificial sequence
  Synthetic oligonucleotide
tttgaagtagatagcgacggccgga

SEQ ID NO: 730029 - DNA, 25 bp, Artificial sequence
  Synthetic oligonucleotide
gtcctccgtatcccgagattcagat

SEQ ID NO: 730030 - DNA, 25 bp, Artificial sequence
  Synthetic oligonucleotide
gtcctccgtatcgcgagattcagat

SEQ ID NO: 730031 - DNA, 25 bp, Artificial sequence
  Synthetic oligonucleotide
tcactttacgcgacccgatgtcaga

SEQ ID NO: 730032 - DNA, 25 bp, Artificial sequence
  Synthetic oligonucleotide
tcactttacgcgtcccgatgtcaga

SEQ ID NO: 730033 - DNA, 25 bp, Artificial sequence
  Synthetic oligonucleotide
tacgtcgtaatgtctcgcgcatcga

SEQ ID NO: 730034 - DNA, 25 bp, Artificial sequence
  Synthetic oligonucleotide
acaacgtaggacaccgtcgtttgac

SEQ ID NO: 730035 - DNA, 25 bp, Artificial sequence
  Synthetic oligonucleotide
ttcacggtttgaacgcgcgttgtac

SEQ ID NO: 730036 - DNA, 25 bp, Artificial sequence
  Synthetic oligonucleotide
agagcataggtccgtagcgcaaaag

SEQ ID NO: 730037 - DNA, 25 bp, Artificial sequence
  Synthetic oligonucleotide
cgtaagcgtataggaggtcaccgat

SEQ ID NO: 730038 - DNA, 25 bp, Artificial sequence
  Synthetic oligonucleotide
cgtaagcgtatacgaggtcaccgat

SEQ ID NO: 730039 - DNA, 25 bp, Artificial sequence
  Synthetic oligonucleotide
gtcagaaggccttgcgcgattatac

SEQ ID NO: 730040 - DNA, 25 bp, Artificial sequence
  Synthetic oligonucleotide
gtcagaaggcctagcgcgattatac

SEQ ID NO: 730041 - DNA, 25 bp, Artificial sequence
  Synthetic oligonucleotide
cccattaggatcgcgtaccaggtaa

SEQ ID NO: 730042 - DNA, 25 bp, Artificial sequence
  Synthetic oligonucleotide
cccattaggatcccgtaccaggtaa

SEQ ID NO: 730043 - DNA, 25 bp, Artificial sequence
  Synthetic oligonucleotide
agtaagcgatccggtatatagcgcg

SEQ ID NO: 730044 - DNA, 25 bp, Artificial sequence
  Synthetic oligonucleotide
gcataaaacacgtctcgcgtctcgt

SEQ ID NO: 730045 - DNA, 25 bp, Artificial sequence
  Synthetic oligonucleotide
agaacgaatagcgcgcgtagacgaa

SEQ ID NO: 730046 - DNA, 25 bp, Artificial sequence
  Synthetic oligonucleotide
agagcataggtcggtagcgcaaaag

SEQ ID NO: 730047 - DNA, 25 bp, Artificial sequence
  Synthetic oligonucleotide
caatggcgatacgcgttaaacgagc

SEQ ID NO: 730048 - DNA, 25 bp, Artificial sequence
  Synthetic oligonucleotide
caatggcgatacccgttaaacgagc

SEQ ID NO: 730049 - DNA, 25 bp, Artificial sequence
  Synthetic oligonucleotide
agcaatcgacgtttcccgtatacgc

SEQ ID NO: 730050 - DNA, 25 bp, Artificial sequence
  Synthetic oligonucleotide
cacttccgatatagcgccttacgga

SEQ ID NO: 730051 - DNA, 25 bp, Artificial sequence
  Synthetic oligonucleotide
aggagctcaggtcgcgtaatacatg

SEQ ID NO: 730052 - DNA, 25 bp, Artificial sequence
  Synthetic oligonucleotide
aggagctcaggtggcgtaatacatg

SEQ ID NO: 730053 - DNA, 25 bp, Artificial sequence
  Synthetic oligonucleotide
gcataaaacacgactcgcgtctcgt

SEQ ID NO: 730054 - DNA, 25 bp, Artificial sequence
  Synthetic oligonucleotide
gtgtttatgtaacgcgcgatgctgc

SEQ ID NO: 730055 - DNA, 25 bp, Artificial sequence
  Synthetic oligonucleotide
ccataccgtaagccgacttaatggg

SEQ ID NO: 730056 - DNA, 25 bp, Artificial sequence
  Synthetic oligonucleotide
ccataccgtaaggcgacttaatggg

SEQ ID NO: 730057 - DNA, 25 bp, Artificial sequence
  Synthetic oligonucleotide
accacgccccgtacgattatgaact

SEQ ID NO: 730058 - DNA, 25 bp, Artificial sequence
  Synthetic oligonucleotide
accacgccccgttcgattatgaact

SEQ ID NO: 730059 - DNA, 25 bp, Artificial sequence
  Synthetic oligonucleotide
gagggctataccgttcgcgttacat

SEQ ID NO: 730060 - DNA, 25 bp, Artificial sequence
  Synthetic oligonucleotide
gagggctatacccttcgcgttacat

SEQ ID NO: 730061 - DNA, 25 bp, Artificial sequence
  Synthetic oligonucleotide
acaacgtaggactccgtcgtttgac

SEQ ID NO: 730062 - DNA, 25 bp, Artificial sequence
  Synthetic oligonucleotide
ggtgctcgtaccgacgtataatgca

SEQ ID NO: 730063 - DNA, 25 bp, Artificial sequence
  Synthetic oligonucleotide
gctccgttatctaaccgcgtctatc

SEQ ID NO: 730064 - DNA, 25 bp, Artificial sequence
  Synthetic oligonucleotide
cttagctcatgaggcgctacgcata

SEQ ID NO: 730065 - DNA, 25 bp, Artificial sequence
  Synthetic oligonucleotide
ctttggccgtacccatagtaggact

SEQ ID NO: 730066 - DNA, 25 bp, Artificial sequence
  Synthetic oligonucleotide
gtgtttatgtaaggcgcgatgctgc

SEQ ID NO: 730067 - DNA, 25 bp, Artificial sequence
  Synthetic oligonucleotide
tatggtacgtaactcgcgaggcagt

SEQ ID NO: 730068 - DNA, 25 bp, Artificial sequence
  Synthetic oligonucleotide
tatggtacgtaagtcgcgaggcagt

SEQ ID NO: 730069 - DNA, 25 bp, Artificial sequence
  Synthetic oligonucleotide
ccaaatacggtccgtaacagagagc

SEQ ID NO: 730070 - DNA, 25 bp, Artificial sequence
  Synthetic oligonucleotide
ccaaatacggtcggtaacagagagc

SEQ ID NO: 730071 - DNA, 25 bp, Artificial sequence
  Synthetic oligonucleotide
gtcaaatacgtacccgctacaagcc

SEQ ID NO: 730072 - DNA, 25 bp, Artificial sequence
  Synthetic oligonucleotide
gtcaaatacgtagccgctacaagcc

SEQ ID NO: 730073 - DNA, 25 bp, Artificial sequence
  Synthetic oligonucleotide
ggtgctcgtacccacgtataatgca

SEQ ID NO: 730074 - DNA, 25 bp, Artificial sequence
  Synthetic oligonucleotide
cttagctcatgacgcgctacgcata

SEQ ID NO: 730075 - DNA, 25 bp, Artificial sequence
  Synthetic oligonucleotide
tcaccatccgtctagcgttcaactc

SEQ ID NO: 730076 - DNA, 25 bp, Artificial sequence
  Synthetic oligonucleotide
ctctagccgttcacgcggattctaa

SEQ ID NO: 730077 - DNA, 25 bp, Artificial sequence
  Synthetic oligonucleotide
aagcagtctcgcctatcgttctggt

SEQ ID NO: 730078 - DNA, 25 bp, Artificial sequence
  Synthetic oligonucleotide
tggagctatcggacgcctatattgg

SEQ ID NO: 730079 - DNA, 25 bp, Artificial sequence
  Synthetic oligonucleotide
tggagctatcggtcgcctatattgg

SEQ ID NO: 730080 - DNA, 25 bp, Artificial sequence
  Synthetic oligonucleotide
ggtcgagagtaaacgcgtagaactc

SEQ ID NO: 730081 - DNA, 25 bp, Artificial sequence
  Synthetic oligonucleotide
ggtcgagagtaatcgcgtagaactc

SEQ ID NO: 730082 - DNA, 25 bp, Artificial sequence
  Synthetic oligonucleotide
accttttcccgataacgcgtgcgaa

SEQ ID NO: 730083 - DNA, 25 bp, Artificial sequence
  Synthetic oligonucleotide
accttttcccgaaaacgcgtgcgaa

SEQ ID NO: 730084 - DNA, 25 bp, Artificial sequence
  Synthetic oligonucleotide
tgaatggtagcgcgatacagtggga

SEQ ID NO: 730085 - DNA, 25 bp, Artificial sequence
  Synthetic oligonucleotide
tccccggcgtaccttaagcatctat

SEQ ID NO: 730086 - DNA, 25 bp, Artificial sequence
  Synthetic oligonucleotide
tgaatggtagcgggatacagtggga

SEQ ID NO: 730087 - DNA, 25 bp, Artificial sequence
  Synthetic oligonucleotide
tcaccatccgtcaagcgttcaactc

SEQ ID NO: 730088 - DNA, 25 bp, Artificial sequence
  Synthetic oligonucleotide
catcggatgcgttgcggacaaagaa

SEQ ID NO: 730089 - DNA, 25 bp, Artificial sequence
  Synthetic oligonucleotide
catcggatgcgtagcggacaaagaa

SEQ ID NO: 730090 - DNA, 25 bp, Artificial sequence
  Synthetic oligonucleotide
caccgacaacgtgcgatacaatggt

SEQ ID NO: 730091 - DNA, 25 bp, Artificial sequence
  Synthetic oligonucleotide
caccgacaacgtccgatacaatggt

SEQ ID NO: 730092 - DNA, 25 bp, Artificial sequence
  Synthetic oligonucleotide
acctctcgtagtagtccgcatcttc

SEQ ID NO: 730093 - DNA, 25 bp, Artificial sequence
  Synthetic oligonucleotide
acctctcgtagttgtccgcatcttc

SEQ ID NO: 730094 - DNA, 25 bp, Artificial sequence
  Synthetic oligonucleotide
ctttggccgtacgcatagtaggact

SEQ ID NO: 730095 - DNA, 25 bp, Artificial sequence
  Synthetic oligonucleotide
gtggcgtcgcgtttataggtagcaa

SEQ ID NO: 730096 - DNA, 25 bp, Artificial sequence
  Synthetic oligonucleotide
tccccggcgtacgttaagcatctat

SEQ ID NO: 730097 - DNA, 25 bp, Artificial sequence
  Synthetic oligonucleotide
cactggataacgtaggcgggaaaga

SEQ ID NO: 730098 - DNA, 25 bp, Artificial sequence
  Synthetic oligonucleotide
ggtaatgtacgatgcgagagatccg

SEQ ID NO: 730099 - DNA, 25 bp, Artificial sequence
  Synthetic oligonucleotide
gacgatttcgtgtcggtcctagagt

SEQ ID NO: 730100 - DNA, 25 bp, Artificial sequence
  Synthetic oligonucleotide
gacgatttcgtgacggtcctagagt

SEQ ID NO: 730101 - DNA, 25 bp, Artificial sequence
  Synthetic oligonucleotide
cgggtacgacgccaagttaattgct

SEQ ID NO: 730102 - DNA, 25 bp, Artificial sequence
  Synthetic oligonucleotide
cgggtacgacgcgaagttaattgct

SEQ ID NO: 730103 - DNA, 25 bp, Artificial sequence
  Synthetic oligonucleotide
cagccatactatgtcgcgagaaagc

SEQ ID NO: 730104 - DNA, 25 bp, Artificial sequence
  Synthetic oligonucleotide
cagccatactatctcgcgagaaagc

SEQ ID NO: 730105 - DNA, 25 bp, Artificial sequence
  Synthetic oligonucleotide
attaggtagtacccggtcttgggag

SEQ ID NO: 730106 - DNA, 25 bp, Artificial sequence
  Synthetic oligonucleotide
gctccgttatcttaccgcgtctatc

SEQ ID NO: 730107 - DNA, 25 bp, Artificial sequence
  Synthetic oligonucleotide
cactggataacgaaggcgggaaaga

SEQ ID NO: 730108 - DNA, 25 bp, Artificial sequence
  Synthetic oligonucleotide
tcaagcctccgtagtcgactagctt

SEQ ID NO: 730109 - DNA, 25 bp, Artificial sequence
  Synthetic oligonucleotide
gcttatgtcgatacggtacccacct

SEQ ID NO: 730110 - DNA, 25 bp, Artificial sequence
  Synthetic oligonucleotide
gcttatgtcgattcggtacccacct

SEQ ID NO: 730111 - DNA, 25 bp, Artificial sequence
  Synthetic oligonucleotide
tcgacttcgactagtccgactagag

SEQ ID NO: 730112 - DNA, 25 bp, Artificial sequence
  Synthetic oligonucleotide
tcgacttcgacttgtccgactagag

SEQ ID NO: 730113 - DNA, 25 bp, Artificial sequence
  Synthetic oligonucleotide
tgcctacgcccgtatacaaacgcaa

SEQ ID NO: 730114 - DNA, 25 bp, Artificial sequence
  Synthetic oligonucleotide
tgcctacgcccgaatacaaacgcaa

SEQ ID NO: 730115 - DNA, 25 bp, Artificial sequence
  Synthetic oligonucleotide
acaacgttgcgttcgcgatgacaac

SEQ ID NO: 730116 - DNA, 25 bp, Artificial sequence
  Synthetic oligonucleotide
acaacgttgcgtacgcgatgacaac

SEQ ID NO: 730117 - DNA, 25 bp, Artificial sequence
  Synthetic oligonucleotide
attaggtagtacgcggtcttgggag

SEQ ID NO: 730118 - DNA, 25 bp, Artificial sequence
  Synthetic oligonucleotide
atgaaatacgcgggacataccctcc

SEQ ID NO: 730119 - DNA, 25 bp, Artificial sequence
  Synthetic oligonucleotide
gtggcgtcgcgtatataggtagcaa

SEQ ID NO: 730120 - DNA, 25 bp, Artificial sequence
  Synthetic oligonucleotide
gctaggacgcgtagacgtagattca

SEQ ID NO: 730121 - DNA, 25 bp, Artificial sequence
  Synthetic oligonucleotide
gctaggacgcgttgacgtagattca

SEQ ID NO: 730122 - DNA, 25 bp, Artificial sequence
  Synthetic oligonucleotide
cgtaattaccgctacggacaagtcc

SEQ ID NO: 730123 - DNA, 25 bp, Artificial sequence
  Synthetic oligonucleotide
cgtaattaccgcaacggacaagtcc

SEQ ID NO: 730124 - DNA, 25 bp, Artificial sequence
  Synthetic oligonucleotide
actccgtattcgggcggattaatcg

SEQ ID NO: 730125 - DNA, 25 bp, Artificial sequence
  Synthetic oligonucleotide
actccgtattcgcgcggattaatcg

SEQ ID NO: 730126 - DNA, 25 bp, Artificial sequence
  Synthetic oligonucleotide
ccaattatccgtggcgatagttcgg

SEQ ID NO: 730127 - DNA, 25 bp, Artificial sequence
  Synthetic oligonucleotide
ggtaatgtacgaagcgagagatccg

SEQ ID NO: 730128 - DNA, 25 bp, Artificial sequence
  Synthetic oligonucleotide
atgaaatacgcgcgacataccctcc

SEQ ID NO: 730129 - DNA, 25 bp, Artificial sequence
  Synthetic oligonucleotide
tcaagcctccgttgtcgactagctt

SEQ ID NO: 730130 - DNA, 25 bp, Artificial sequence
  Synthetic oligonucleotide
ctacgttgttgcgaccgtcgatttc

SEQ ID NO: 730131 - DNA, 25 bp, Artificial sequence
  Synthetic oligonucleotide
ctacgttgttgccaccgtcgatttc

SEQ ID NO: 730132 - DNA, 25 bp, Artificial sequence
  Synthetic oligonucleotide
tgccactggaatggcgcatagactt

SEQ ID NO: 730133 - DNA, 25 bp, Artificial sequence
  Synthetic oligonucleotide
tgccactggaatcgcgcatagactt

SEQ ID NO: 730134 - DNA, 25 bp, Artificial sequence
  Synthetic oligonucleotide
tacagacgagcgcgtaactagtcct

SEQ ID NO: 730135 - DNA, 25 bp, Artificial sequence
  Synthetic oligonucleotide
tacagacgagcgggtaactagtcct

SEQ ID NO: 730136 - DNA, 25 bp, Artificial sequence
  Synthetic oligonucleotide
gtgttgaacggtatgcgcgataacg

SEQ ID NO: 730137 - DNA, 25 bp, Artificial sequence
  Synthetic oligonucleotide
gtgttgaacggtttgcgcgataacg

SEQ ID NO: 730138 - DNA, 25 bp, Artificial sequence
  Synthetic oligonucleotide
tacgtcgtaatgactcgcgcatcga

SEQ ID NO: 730139 - DNA, 25 bp, Artificial sequence
  Synthetic oligonucleotide
ccaattatccgtcgcgatagttcgg

SEQ ID NO: 730140 - DNA, 25 bp, Artificial sequence
  Synthetic oligonucleotide
cggtaccggaacccgactaagaata

SEQ ID NO: 730141 - DNA, 25 bp, Artificial sequence
  Synthetic oligonucleotide
ccgcacatgcgccattaggtatctt

SEQ ID NO: 730142 - DNA, 25 bp, Artificial sequence
  Synthetic oligonucleotide
gagaggacgacggaagtcgaaacaa

SEQ ID NO: 730143 - DNA, 25 bp, Artificial sequence
  Synthetic oligonucleotide
gagaggacgacgcaagtcgaaacaa

SEQ ID NO: 730144 - DNA, 25 bp, Artificial sequence
  Synthetic oligonucleotide
ctatggcgcgtagtgaaacgggaat

SEQ ID NO: 730145 - DNA, 25 bp, Artificial sequence
  Synthetic oligonucleotide
ctatggcgcgtactgaaacgggaat

SEQ ID NO: 730146 - DNA, 25 bp, Artificial sequence
  Synthetic oligonucleotide
cactatgcgtaccgacgatgtgagt

SEQ ID NO: 730147 - DNA, 25 bp, Artificial sequence
  Synthetic oligonucleotide
cactatgcgtacggacgatgtgagt

SEQ ID NO: 730148 - DNA, 25 bp, Artificial sequence
  Synthetic oligonucleotide
gtctggtaagtagcggtcgcgtaat

SEQ ID NO: 730149 - DNA, 25 bp, Artificial sequence
  Synthetic oligonucleotide
gtctggtaagtaccggtcgcgtaat

SEQ ID NO: 730150 - DNA, 25 bp, Artificial sequence
  Synthetic oligonucleotide
gcacctctatgaatgcgcgagctta

SEQ ID NO: 730151 - DNA, 25 bp, Artificial sequence
  Synthetic oligonucleotide
gcacctctatgattgcgcgagctta

SEQ ID NO: 730152 - DNA, 25 bp, Artificial sequence
  Synthetic oligonucleotide
gcagcttatgttgcggacgtttgtc

SEQ ID NO: 730153 - DNA, 25 bp, Artificial sequence
  Synthetic oligonucleotide
aattcctcgatcgacggtcggaatg

SEQ ID NO: 730154 - DNA, 25 bp, Artificial sequence
  Synthetic oligonucleotide
cggtaccggaacgcgactaagaata

SEQ ID NO: 730155 - DNA, 25 bp, Artificial sequence
  Synthetic oligonucleotide
ggtacgctatatctcgcgctcattc

SEQ ID NO: 730156 - DNA, 25 bp, Artificial sequence
  Synthetic oligonucleotide
ttctgataccggagtacgcaagacc

SEQ ID NO: 730157 - DNA, 25 bp, Artificial sequence
  Synthetic oligonucleotide
ttctgataccggtgtacgcaagacc

SEQ ID NO: 730158 - DNA, 25 bp, Artificial sequence
  Synthetic oligonucleotide
caatgaagcgtagcgttcgcttcct

SEQ ID NO: 730159 - DNA, 25 bp, Artificial sequence
  Synthetic oligonucleotide
caatgaagcgtaccgttcgcttcct

SEQ ID NO: 730160 - DNA, 25 bp, Artificial sequence
  Synthetic oligonucleotide
gtcgcttaggcgtaccgtaaatcac

SEQ ID NO: 730161 - DNA, 25 bp, Artificial sequence
  Synthetic oligonucleotide
gtcgcttaggcgaaccgtaaatcac

SEQ ID NO: 730162 - DNA, 25 bp, Artificial sequence
  Synthetic oligonucleotide
tactgagtcaattcgcgcggggtaa

SEQ ID NO: 730163 - DNA, 25 bp, Artificial sequence
  Synthetic oligonucleotide
tactgagtcaatacgcgcggggtaa

SEQ ID NO: 730164 - DNA, 25 bp, Artificial sequence
  Synthetic oligonucleotide
gtcggtaccgacccgtttagatgtt

SEQ ID NO: 730165 - DNA, 25 bp, Artificial sequence
  Synthetic oligonucleotide
gtcggtaccgacgcgtttagatgtt

SEQ ID NO: 730166 - DNA, 25 bp, Artificial sequence
  Synthetic oligonucleotide
ggtatagctagcggcgtaagctttc

SEQ ID NO: 730167 - DNA, 25 bp, Artificial sequence
  Synthetic oligonucleotide
ggtatagctagccgcgtaagctttc

SEQ ID NO: 730168 - DNA, 25 bp, Artificial sequence
  Synthetic oligonucleotide
ttggctccgcgttatgactaccgat

SEQ ID NO: 730169 - DNA, 25 bp, Artificial sequence
  Synthetic oligonucleotide
gcagcttatgttccggacgtttgtc

SEQ ID NO: 730170 - DNA, 25 bp, Artificial sequence
  Synthetic oligonucleotide
tgaagtcgtgttggcgaatagggtc

SEQ ID NO: 730171 - DNA, 25 bp, Artificial sequence
  Synthetic oligonucleotide
ccgcacatgcgcgattaggtatctt

SEQ ID NO: 730172 - DNA, 25 bp, Artificial sequence
  Synthetic oligonucleotide
gacacgcgattccacgtcctaattg

SEQ ID NO: 730173 - DNA, 25 bp, Artificial sequence
  Synthetic oligonucleotide
gacacgcgattcgacgtcctaattg

SEQ ID NO: 730174 - DNA, 25 bp, Artificial sequence
  Synthetic oligonucleotide
gcaagaacgtatcacgcgcaaaagc

SEQ ID NO: 730175 - DNA, 25 bp, Artificial sequence
  Synthetic oligonucleotide
gcaagaacgtatgacgcgcaaaagc

SEQ ID NO: 730176 - DNA, 25 bp, Artificial sequence
  Synthetic oligonucleotide
cgcgctcgaaagacgtatcatcaag

SEQ ID NO: 730177 - DNA, 25 bp, Artificial sequence
  Synthetic oligonucleotide
cgcgctcgaaagtcgtatcatcaag

SEQ ID NO: 730178 - DNA, 25 bp, Artificial sequence
  Synthetic oligonucleotide
catgcttacgcgaattcgcgcagaa

SEQ ID NO: 730179 - DNA, 25 bp, Artificial sequence
  Synthetic oligonucleotide
catgcttacgcgtattcgcgcagaa

SEQ ID NO: 730180 - DNA, 25 bp, Artificial sequence
  Synthetic oligonucleotide
taaggggccgctagacgaagtaatc

SEQ ID NO: 730181 - DNA, 25 bp, Artificial sequence
  Synthetic oligonucleotide
taaggggccgcttgacgaagtaatc

SEQ ID NO: 730182 - DNA, 25 bp, Artificial sequence
  Synthetic oligonucleotide
gggatggatagcctaccgtgttaag

SEQ ID NO: 730183 - DNA, 25 bp, Artificial sequence
  Synthetic oligonucleotide
aattcctcgatccacggtcggaatg

SEQ ID NO: 730184 - DNA, 25 bp, Artificial sequence
  Synthetic oligonucleotide
tgaagtcgtgttcgcgaatagggtc

SEQ ID NO: 730185 - DNA, 25 bp, Artificial sequence
  Synthetic oligonucleotide
aaaatgtctacccgacgtcccagag

SEQ ID NO: 730186 - DNA, 25 bp, Artificial sequence
  Synthetic oligonucleotide
ttgcgactcggttgcgcatttgttg

SEQ ID NO: 730187 - DNA, 25 bp, Artificial sequence
  Synthetic oligonucleotide
ttgcgactcggtagcgcatttgttg

SEQ ID NO: 730188 - DNA, 25 bp, Artificial sequence
  Synthetic oligonucleotide
ccttgacgtccgtatggtacgtagt

SEQ ID NO: 730189 - DNA, 25 bp, Artificial sequence
  Synthetic oligonucleotide
ccttgacgtccgaatggtacgtagt

SEQ ID NO: 730190 - DNA, 25 bp, Artificial sequence
  Synthetic oligonucleotide
aaagcgctcggttcgacgttgttgt

SEQ ID NO: 730191 - DNA, 25 bp, Artificial sequence
  Synthetic oligonucleotide
aaagcgctcggtacgacgttgttgt

SEQ ID NO: 730192 - DNA, 25 bp, Artificial sequence
  Synthetic oligonucleotide
tgccagcgtcgctagtaatatagcg

SEQ ID NO: 730193 - DNA, 25 bp, Artificial sequence
  Synthetic oligonucleotide
tgccagcgtcgcaagtaatatagcg

SEQ ID NO: 730194 - DNA, 25 bp, Artificial sequence
  Synthetic oligonucleotide
cacagccgatagaatgcggtatgtc

SEQ ID NO: 730195 - DNA, 25 bp, Artificial sequence
  Synthetic oligonucleotide
cacagccgatagtatgcggtatgtc

SEQ ID NO: 730196 - DNA, 25 bp, Artificial sequence
  Synthetic oligonucleotide
gcctatacccgtggcttaaaacgac

SEQ ID NO: 730197 - DNA, 25 bp, Artificial sequence
  Synthetic oligonucleotide
gcctatacccgtcgcttaaaacgac

SEQ ID NO: 730198 - DNA, 25 bp, Artificial sequence
  Synthetic oligonucleotide
ggtacgctatatgtcgcgctcattc

SEQ ID NO: 730199 - DNA, 25 bp, Artificial sequence
  Synthetic oligonucleotide
gggatggatagcgtaccgtgttaag

SEQ ID NO: 730200 - DNA, 25 bp, Artificial sequence
  Synthetic oligonucleotide
acgacagtactaaaggcggtccaca

SEQ ID NO: 730201 - DNA, 25 bp, Artificial sequence
  Synthetic oligonucleotide
tacgactagtacccgcgatgtcaga

SEQ ID NO: 730202 - DNA, 25 bp, Artificial sequence
  Synthetic oligonucleotide
gtaggctacggaccggttattatgg

SEQ ID NO: 730203 - DNA, 25 bp, Artificial sequence
  Synthetic oligonucleotide
gtaggctacggagcggttattatgg

SEQ ID NO: 730204 - DNA, 25 bp, Artificial sequence
  Synthetic oligonucleotide
ataaaggatataacgcgcgggtggg

SEQ ID NO: 730205 - DNA, 25 bp, Artificial sequence
  Synthetic oligonucleotide
ataaaggatatatcgcgcgggtggg

SEQ ID NO: 730206 - DNA, 25 bp, Artificial sequence
  Synthetic oligonucleotide
gagtattagtacgagcgcggaaagg

SEQ ID NO: 730207 - DNA, 25 bp, Artificial sequence
  Synthetic oligonucleotide
gagtattagtaccagcgcggaaagg

SEQ ID NO: 730208 - DNA, 25 bp, Artificial sequence
  Synthetic oligonucleotide
ctaataactaaccgccgatggcacc

SEQ ID NO: 730209 - DNA, 25 bp, Artificial sequence
  Synthetic oligonucleotide
ctaataactaacggccgatggcacc

SEQ ID NO: 730210 - DNA, 25 bp, Artificial sequence
  Synthetic oligonucleotide
ccgttgagtgatcgcgacgtataga

SEQ ID NO: 730211 - DNA, 25 bp, Artificial sequence
  Synthetic oligonucleotide
ccgttgagtgatggcgacgtataga

SEQ ID NO: 730212 - DNA, 25 bp, Artificial sequence
  Synthetic oligonucleotide
acgacagtactataggcggtccaca

SEQ ID NO: 730213 - DNA, 25 bp, Artificial sequence
  Synthetic oligonucleotide
ttggctccgcgtaatgactaccgat

SEQ ID NO: 730214 - DNA, 25 bp, Artificial sequence
  Synthetic oligonucleotide
ctctagccgttctcgcggattctaa

SEQ ID NO: 730215 - DNA, 25 bp, Artificial sequence
  Synthetic oligonucleotide
atcagtttatcgcgtacggtacgcg

SEQ ID NO: 730216 - DNA, 25 bp, Artificial sequence
  Synthetic oligonucleotide
taacgccgcgattctttcgaatggc

SEQ ID NO: 730217 - DNA, 25 bp, Artificial sequence
  Synthetic oligonucleotide
taacgccgcgatactttcgaatggc

SEQ ID NO: 730218 - DNA, 25 bp, Artificial sequence
  Synthetic oligonucleotide
tggtggcgataccgcgctagaaatt

SEQ ID NO: 730219 - DNA, 25 bp, Artificial sequence
  Synthetic oligonucleotide
tggtggcgatacggcgctagaaatt

SEQ ID NO: 730220 - DNA, 25 bp, Artificial sequence
  Synthetic oligonucleotide
catgacattccggcccgatattcac

SEQ ID NO: 730221 - DNA, 25 bp, Artificial sequence
  Synthetic oligonucleotide
catgacattccgccccgatattcac

SEQ ID NO: 730222 - DNA, 25 bp, Artificial sequence
  Synthetic oligonucleotide
cctcctcgttcggtcgatctgtaaa

SEQ ID NO: 730223 - DNA, 25 bp, Artificial sequence
  Synthetic oligonucleotide
cctcctcgttcgctcgatctgtaaa

SEQ ID NO: 730224 - DNA, 25 bp, Artificial sequence
  Synthetic oligonucleotide
gcttcttacttgggcgcgaccttta

SEQ ID NO: 730225 - DNA, 25 bp, Artificial sequence
  Synthetic oligonucleotide
gcttcttacttgcgcgcgaccttta

SEQ ID NO: 730226 - DNA, 25 bp, Artificial sequence
  Synthetic oligonucleotide
tattggtacgcgcacgttacggact

SEQ ID NO: 730227 - DNA, 25 bp, Artificial sequence
  Synthetic oligonucleotide
tattggtacgcggacgttacggact

SEQ ID NO: 730228 - DNA, 25 bp, Artificial sequence
  Synthetic oligonucleotide
cttactcgacgttctctagcgtgac

SEQ ID NO: 730229 - DNA, 25 bp, Artificial sequence
  Synthetic oligonucleotide
aactgattcgcgttaacggtctgcc

SEQ ID NO: 730230 - DNA, 25 bp, Artificial sequence
  Synthetic oligonucleotide
gttggggcgatatgtaccgcataga

SEQ ID NO: 730231 - DNA, 25 bp, Artificial sequence
  Synthetic oligonucleotide
aaacctactgcgtacgagtgctagc

SEQ ID NO: 730232 - DNA, 25 bp, Artificial sequence
  Synthetic oligonucleotide
gtcttcaatgcgaacgctcgtcgtt

SEQ ID NO: 730233 - DNA, 25 bp, Artificial sequence
  Synthetic oligonucleotide
gtcttcaatgcgtacgctcgtcgtt

SEQ ID NO: 730234 - DNA, 25 bp, Artificial sequence
  Synthetic oligonucleotide
cttactcgacgtactctagcgtgac

SEQ ID NO: 730235 - DNA, 25 bp, Artificial sequence
  Synthetic oligonucleotide
cctatagtcccgggattaacggcaa

SEQ ID NO: 730236 - DNA, 25 bp, Artificial sequence
  Synthetic oligonucleotide
cctatagtcccgcgattaacggcaa

SEQ ID NO: 730237 - DNA, 25 bp, Artificial sequence
  Synthetic oligonucleotide
gattgttagcgcgttaaccagggtc

SEQ ID NO: 730238 - DNA, 25 bp, Artificial sequence
  Synthetic oligonucleotide
gattgttagcgccttaaccagggtc

SEQ ID NO: 730239 - DNA, 25 bp, Artificial sequence
  Synthetic oligonucleotide
tcttcacgttaacgaacgccctcag

SEQ ID NO: 730240 - DNA, 25 bp, Artificial sequence
  Synthetic oligonucleotide
tcttcacgttaaggaacgccctcag

SEQ ID NO: 730241 - DNA, 25 bp, Artificial sequence
  Synthetic oligonucleotide
tatgcgtcgtatagcggacatgtcg

SEQ ID NO: 730242 - DNA, 25 bp, Artificial sequence
  Synthetic oligonucleotide
tatgcgtcgtattgcggacatgtcg

SEQ ID NO: 730243 - DNA, 25 bp, Artificial sequence
  Synthetic oligonucleotide
gtgagcgtacgccttatacgtatgg

SEQ ID NO: 730244 - DNA, 25 bp, Artificial sequence
  Synthetic oligonucleotide
tacgactagtacgcgcgatgtcaga

SEQ ID NO: 730245 - DNA, 25 bp, Artificial sequence
  Synthetic oligonucleotide
ggctgcacgccgtataggaagaata

SEQ ID NO: 730246 - DNA, 25 bp, Artificial sequence
  Synthetic oligonucleotide
aaaatgtctaccggacgtcccagag

SEQ ID NO: 730247 - DNA, 25 bp, Artificial sequence
  Synthetic oligonucleotide
aagtgacgcggtttagtagcggctt

SEQ ID NO: 730248 - DNA, 25 bp, Artificial sequence
  Synthetic oligonucleotide
aagtgacgcggtatagtagcggctt

SEQ ID NO: 730249 - DNA, 25 bp, Artificial sequence
  Synthetic oligonucleotide
tccgaaccgcgacgatataactcgt

SEQ ID NO: 730250 - DNA, 25 bp, Artificial sequence
  Synthetic oligonucleotide
tccgaaccgcgaggatataactcgt

SEQ ID NO: 730251 - DNA, 25 bp, Artificial sequence
  Synthetic oligonucleotide
gtgagcgtacgcgttatacgtatgg

SEQ ID NO: 730252 - DNA, 25 bp, Artificial sequence
  Synthetic oligonucleotide
aaacctactgcgaacgagtgctagc

SEQ ID NO: 730253 - DNA, 25 bp, Artificial sequence
  Synthetic oligonucleotide
gttggggcgataagtaccgcataga

SEQ ID NO: 730254 - DNA, 25 bp, Artificial sequence
  Synthetic oligonucleotide
ggctgcacgccgaataggaagaata

SEQ ID NO: 730255 - DNA, 25 bp, Artificial sequence
  Synthetic oligonucleotide
caatattcggacgtgtacgtcgggt

SEQ ID NO: 730256 - DNA, 25 bp, Artificial sequence
  Synthetic oligonucleotide
caatattcggacctgtacgtcgggt

SEQ ID NO: 730257 - DNA, 25 bp, Artificial sequence
  Synthetic oligonucleotide
gaaccttcgagtacgtacgtactgc

SEQ ID NO: 730258 - DNA, 25 bp, Artificial sequence
  Synthetic oligonucleotide
gaaccttcgagttcgtacgtactgc

SEQ ID NO: 730259 - DNA, 25 bp, Artificial sequence
  Synthetic oligonucleotide
atcagtttatcgggtacggtacgcg

SEQ ID NO: 730260 - DNA, 25 bp, Artificial sequence
  Synthetic oligonucleotide
ggatactacgatgggtggcatatgc

SEQ ID NO: 730261 - DNA, 25 bp, Artificial sequence
  Synthetic oligonucleotide
catctcaacgcggaaccgtggataa

SEQ ID NO: 730262 - DNA, 25 bp, Artificial sequence
  Synthetic oligonucleotide
ccttccagtcgcctaacgtaaatgc

SEQ ID NO: 730263 - DNA, 25 bp, Artificial sequence
  Synthetic oligonucleotide
gcacctcggccgaagattaactttg

SEQ ID NO: 730264 - DNA, 25 bp, Artificial sequence
  Synthetic oligonucleotide
taggtgttcgcgaattcggcgcttt

SEQ ID NO: 730265 - DNA, 25 bp, Artificial sequence
  Synthetic oligonucleotide
taggtgttcgcgtattcggcgcttt

SEQ ID NO: 730266 - DNA, 25 bp, Artificial sequence
  Synthetic oligonucleotide
accgtgtatgtcccgatacgttagg

SEQ ID NO: 730267 - DNA, 25 bp, Artificial sequence
  Synthetic oligonucleotide
accgtgtatgtcgcgatacgttagg

SEQ ID NO: 730268 - DNA, 25 bp, Artificial sequence
  Synthetic oligonucleotide
gtgaaaatcggccgtaagcactacg

SEQ ID NO: 730269 - DNA, 25 bp, Artificial sequence
  Synthetic oligonucleotide
gtgaaaatcggcggtaagcactacg

SEQ ID NO: 730270 - DNA, 25 bp, Artificial sequence
  Synthetic oligonucleotide
caagctcgacgctcgatagactcta

SEQ ID NO: 730271 - DNA, 25 bp, Artificial sequence
  Synthetic oligonucleotide
caagctcgacgcacgatagactcta

SEQ ID NO: 730272 - DNA, 25 bp, Artificial sequence
  Synthetic oligonucleotide
ttcctgatcgcgatacacgactgtc

SEQ ID NO: 730273 - DNA, 25 bp, Artificial sequence
  Synthetic oligonucleotide
ttcctgatcgcgttacacgactgtc

SEQ ID NO: 730274 - DNA, 25 bp, Artificial sequence
  Synthetic oligonucleotide
ctttcaggtagccctcgaatgccat

SEQ ID NO: 730275 - DNA, 25 bp, Artificial sequence
  Synthetic oligonucleotide
gcctctccgtttggcggtaaactta

SEQ ID NO: 730276 - DNA, 25 bp, Artificial sequence
  Synthetic oligonucleotide
ctttcaggtagcgctcgaatgccat

SEQ ID NO: 730277 - DNA, 25 bp, Artificial sequence
  Synthetic oligonucleotide
catctcaacgcgcaaccgtggataa

SEQ ID NO: 730278 - DNA, 25 bp, Artificial sequence
  Synthetic oligonucleotide
gtttcttcttatgcgcgaccgagca

SEQ ID NO: 730279 - DNA, 25 bp, Artificial sequence
  Synthetic oligonucleotide
gtttcttcttatccgcgaccgagca

SEQ ID NO: 730280 - DNA, 25 bp, Artificial sequence
  Synthetic oligonucleotide
cattgacgcgataccgtcaaaggtc

SEQ ID NO: 730281 - DNA, 25 bp, Artificial sequence
  Synthetic oligonucleotide
cattgacgcgattccgtcaaaggtc

SEQ ID NO: 730282 - DNA, 25 bp, Artificial sequence
  Synthetic oligonucleotide
tgatagtacgcttcgcggaccacat

SEQ ID NO: 730283 - DNA, 25 bp, Artificial sequence
  Synthetic oligonucleotide
tgatagtacgctacgcggaccacat

SEQ ID NO: 730284 - DNA, 25 bp, Artificial sequence
  Synthetic oligonucleotide
ttggcttaaaccccgtagctgtgtg

SEQ ID NO: 730285 - DNA, 25 bp, Artificial sequence
  Synthetic oligonucleotide
ttggcttaaaccgcgtagctgtgtg

SEQ ID NO: 730286 - DNA, 25 bp, Artificial sequence
  Synthetic oligonucleotide
agttccccgtctaatcgcggatatc

SEQ ID NO: 730287 - DNA, 25 bp, Artificial sequence
  Synthetic oligonucleotide
agttccccgtcttatcgcggatatc

SEQ ID NO: 730288 - DNA, 25 bp, Artificial sequence
  Synthetic oligonucleotide
tgtgatccgactaacgcggaggttt

SEQ ID NO: 730289 - DNA, 25 bp, Artificial sequence
  Synthetic oligonucleotide
tgtgatccgacttacgcggaggttt

SEQ ID NO: 730290 - DNA, 25 bp, Artificial sequence
  Synthetic oligonucleotide
gcctctccgtttcgcggtaaactta

SEQ ID NO: 730291 - DNA, 25 bp, Artificial sequence
  Synthetic oligonucleotide
agtatacgctagtcggtcggggatt

SEQ ID NO: 730292 - DNA, 25 bp, Artificial sequence
  Synthetic oligonucleotide
ggatactacgatcggtggcatatgc

SEQ ID NO: 730293 - DNA, 25 bp, Artificial sequence
  Synthetic oligonucleotide
caagtaagtgcgtcgtacgcgcaat

SEQ ID NO: 730294 - DNA, 25 bp, Artificial sequence
  Synthetic oligonucleotide
ctatgcgtcttaacgcgcggatagt

SEQ ID NO: 730295 - DNA, 25 bp, Artificial sequence
  Synthetic oligonucleotide
ctatgcgtcttatcgcgcggatagt

SEQ ID NO: 730296 - DNA, 25 bp, Artificial sequence
  Synthetic oligonucleotide
atgtaaccgggttcgatcagaggca

SEQ ID NO: 730297 - DNA, 25 bp, Artificial sequence
  Synthetic oligonucleotide
acggtacgtacatacgcgttgtctc

SEQ ID NO: 730298 - DNA, 25 bp, Artificial sequence
  Synthetic oligonucleotide
atgtaaccgggtacgatcagaggca

SEQ ID NO: 730299 - DNA, 25 bp, Artificial sequence
  Synthetic oligonucleotide
acggtacgtacaaacgcgttgtctc

SEQ ID NO: 730300 - DNA, 25 bp, Artificial sequence
  Synthetic oligonucleotide
gattcgatcgcggcgtaagaatcca

SEQ ID NO: 730301 - DNA, 25 bp, Artificial sequence
  Synthetic oligonucleotide
gattcgatcgcgccgtaagaatcca

SEQ ID NO: 730302 - DNA, 25 bp, Artificial sequence
  Synthetic oligonucleotide
aagcagtctcgcgtatcgttctggt

SEQ ID NO: 730303 - DNA, 25 bp, Artificial sequence
  Synthetic oligonucleotide
tagaaccgtccgatcggtaacttcc

SEQ ID NO: 730304 - DNA, 25 bp, Artificial sequence
  Synthetic oligonucleotide
gcacctcggccgtagattaactttg

SEQ ID NO: 730305 - DNA, 25 bp, Artificial sequence
  Synthetic oligonucleotide
tagaaccgtccgttcggtaacttcc

SEQ ID NO: 730306 - DNA, 25 bp, Artificial sequence
  Synthetic oligonucleotide
catatatatacgtcgcgtcggcctc

SEQ ID NO: 730307 - DNA, 25 bp, Artificial sequence
  Synthetic oligonucleotide
agtatacgctagacggtcggggatt

SEQ ID NO: 730308 - DNA, 25 bp, Artificial sequence
  Synthetic oligonucleotide
gtacttaccgccccgaataaagagc

SEQ ID NO: 730309 - DNA, 25 bp, Artificial sequence
  Synthetic oligonucleotide
gtacttaccgccgcgaataaagagc

SEQ ID NO: 730310 - DNA, 25 bp, Artificial sequence
  Synthetic oligonucleotide
aagcattgcgaaggatacgcccatc

SEQ ID NO: 730311 - DNA, 25 bp, Artificial sequence
  Synthetic oligonucleotide
aagcattgcgaacgatacgcccatc

SEQ ID NO: 730312 - DNA, 25 bp, Artificial sequence
  Synthetic oligonucleotide
tctctagcgttattcgcccggtaac

SEQ ID NO: 730313 - DNA, 25 bp, Artificial sequence
  Synthetic oligonucleotide
tctctagcgttaatcgcccggtaac

SEQ ID NO: 730314 - DNA, 25 bp, Artificial sequence
  Synthetic oligonucleotide
actacacgcgatttagctccgagga

SEQ ID NO: 730315 - DNA, 25 bp, Artificial sequence
  Synthetic oligonucleotide
catatatatacgacgcgtcggcctc

SEQ ID NO: 730316 - DNA, 25 bp, Artificial sequence
  Synthetic oligonucleotide
tagtcaacggagggacgtaccgaaa

SEQ ID NO: 730317 - DNA, 25 bp, Artificial sequence
  Synthetic oligonucleotide
tagtcaacggagcgacgtaccgaaa

SEQ ID NO: 730318 - DNA, 25 bp, Artificial sequence
  Synthetic oligonucleotide
tgagtagttaacccccgatgcactg

SEQ ID NO: 730319 - DNA, 25 bp, Artificial sequence
  Synthetic oligonucleotide
tgagtagttaacgcccgatgcactg

SEQ ID NO: 730320 - DNA, 25 bp, Artificial sequence
  Synthetic oligonucleotide
aactgattcgcgataacggtctgcc

SEQ ID NO: 730321 - DNA, 25 bp, Artificial sequence
  Synthetic oligonucleotide
ccgttccgttcgcgagtaataacac

SEQ ID NO: 730322 - DNA, 25 bp, Artificial sequence
  Synthetic oligonucleotide
actttatccgcgggatagtagcagg

SEQ ID NO: 730323 - DNA, 25 bp, Artificial sequence
  Synthetic oligonucleotide
actttatccgcgcgatagtagcagg

SEQ ID NO: 730324 - DNA, 25 bp, Artificial sequence
  Synthetic oligonucleotide
gaaccgcgcgttaggctactataag

SEQ ID NO: 730325 - DNA, 25 bp, Artificial sequence
  Synthetic oligonucleotide
gaaccgcgcgtttggctactataag

SEQ ID NO: 730326 - DNA, 25 bp, Artificial sequence
  Synthetic oligonucleotide
ttgggttccgtcctactagtgttgc

SEQ ID NO: 730327 - DNA, 25 bp, Artificial sequence
  Synthetic oligonucleotide
ttgggttccgtcgtactagtgttgc

SEQ ID NO: 730328 - DNA, 25 bp, Artificial sequence
  Synthetic oligonucleotide
ggtcgagtacgtatccgtttcgtga

SEQ ID NO: 730329 - DNA, 25 bp, Artificial sequence
  Synthetic oligonucleotide
ggtcgagtacgtttccgtttcgtga

SEQ ID NO: 730330 - DNA, 25 bp, Artificial sequence
  Synthetic oligonucleotide
gttgatgcgtacgtctgacctgtac

SEQ ID NO: 730331 - DNA, 25 bp, Artificial sequence
  Synthetic oligonucleotide
gttgatgcgtacctctgacctgtac

SEQ ID NO: 730332 - DNA, 25 bp, Artificial sequence
  Synthetic oligonucleotide
tcttatatacgcgcgtctgcaacgc

SEQ ID NO: 730333 - DNA, 25 bp, Artificial sequence
  Synthetic oligonucleotide
tcttatatacgcccgtctgcaacgc

SEQ ID NO: 730334 - DNA, 25 bp, Artificial sequence
  Synthetic oligonucleotide
gttcgcagtcgtattgcgcgataga

SEQ ID NO: 730335 - DNA, 25 bp, Artificial sequence
  Synthetic oligonucleotide
ccaatttttacgtaccgcgctgcga

SEQ ID NO: 730336 - DNA, 25 bp, Artificial sequence
  Synthetic oligonucleotide
ccttccagtcgcgtaacgtaaatgc

SEQ ID NO: 730337 - DNA, 25 bp, Artificial sequence
  Synthetic oligonucleotide
caagtaagtgcgacgtacgcgcaat

SEQ ID NO: 730338 - DNA, 25 bp, Artificial sequence
  Synthetic oligonucleotide
gaatcctagatacgtcgcgtgagca

SEQ ID NO: 730339 - DNA, 25 bp, Artificial sequence
  Synthetic oligonucleotide
gaatcctagataggtcgcgtgagca

SEQ ID NO: 730340 - DNA, 25 bp, Artificial sequence
  Synthetic oligonucleotide
atgtgatgcgacggtaataccggca

SEQ ID NO: 730341 - DNA, 25 bp, Artificial sequence
  Synthetic oligonucleotide
atgtgatgcgaccgtaataccggca

SEQ ID NO: 730342 - DNA, 25 bp, Artificial sequence
  Synthetic oligonucleotide
gttcgcagtcgttttgcgcgataga

SEQ ID NO: 730343 - DNA, 25 bp, Artificial sequence
  Synthetic oligonucleotide
caccaatcgccgattacgtgacatc

SEQ ID NO: 730344 - DNA, 25 bp, Artificial sequence
  Synthetic oligonucleotide
ccgttccgttcgggagtaataacac

SEQ ID NO: 730345 - DNA, 25 bp, Artificial sequence
  Synthetic oligonucleotide
gacctattaacgtccggacagggta

SEQ ID NO: 730346 - DNA, 25 bp, Artificial sequence
  Synthetic oligonucleotide
gctcagctatacgagcggaacattc

SEQ ID NO: 730347 - DNA, 25 bp, Artificial sequence
  Synthetic oligonucleotide
gctcagctataccagcggaacattc

SEQ ID NO: 730348 - DNA, 25 bp, Artificial sequence
  Synthetic oligonucleotide
acaggacgcgtatgcatagatgtcc

SEQ ID NO: 730349 - DNA, 25 bp, Artificial sequence
  Synthetic oligonucleotide
acaggacgcgtaagcatagatgtcc

SEQ ID NO: 730350 - DNA, 25 bp, Artificial sequence
  Synthetic oligonucleotide
gacctattaacgaccggacagggta

SEQ ID NO: 730351 - DNA, 25 bp, Artificial sequence
  Synthetic oligonucleotide
actacacgcgatatagctccgagga

SEQ ID NO: 730352 - DNA, 25 bp, Artificial sequence
  Synthetic oligonucleotide
ctatgagcgatggtacgtttgctcc

SEQ ID NO: 730353 - DNA, 25 bp, Artificial sequence
  Synthetic oligonucleotide
tatggtcgctagatcggtcccacta

SEQ ID NO: 730354 - DNA, 25 bp, Artificial sequence
  Synthetic oligonucleotide
gacatccgcgtacatacgagggttt

SEQ ID NO: 730355 - DNA, 25 bp, Artificial sequence
  Synthetic oligonucleotide
gacatccgcgtagatacgagggttt

SEQ ID NO: 730356 - DNA, 25 bp, Artificial sequence
  Synthetic oligonucleotide
gatttaagcctcctaacgcgtggag

SEQ ID NO: 730357 - DNA, 25 bp, Artificial sequence
  Synthetic oligonucleotide
gatttaagcctcgtaacgcgtggag

SEQ ID NO: 730358 - DNA, 25 bp, Artificial sequence
  Synthetic oligonucleotide
gtctaggtacgcacgtcatagtgac

SEQ ID NO: 730359 - DNA, 25 bp, Artificial sequence
  Synthetic oligonucleotide
gcaacattacgcctctacgtaggag

SEQ ID NO: 730360 - DNA, 25 bp, Artificial sequence
  Synthetic oligonucleotide
tatggtcgctagttcggtcccacta

SEQ ID NO: 730361 - DNA, 25 bp, Artificial sequence
  Synthetic oligonucleotide
ctatgagcgatgctacgtttgctcc

SEQ ID NO: 730362 - DNA, 25 bp, Artificial sequence
  Synthetic oligonucleotide
gcaacattacgcgtctacgtaggag

SEQ ID NO: 730363 - DNA, 25 bp, Artificial sequence
  Synthetic oligonucleotide
tcgttcactaccggtcgagccatta

SEQ ID NO: 730364 - DNA, 25 bp, Artificial sequence
  Synthetic oligonucleotide
tcgttcactacccgtcgagccatta

SEQ ID NO: 730365 - DNA, 25 bp, Artificial sequence
  Synthetic oligonucleotide
aatatggcgagactagtcgggcttc

SEQ ID NO: 730366 - DNA, 25 bp, Artificial sequence
  Synthetic oligonucleotide
aatatggcgagagtagtcgggcttc

SEQ ID NO: 730367 - DNA, 25 bp, Artificial sequence
  Synthetic oligonucleotide
ccaatttttacgaaccgcgctgcga

SEQ ID NO: 730368 - DNA, 25 bp, Artificial sequence
  Synthetic oligonucleotide
caccaatcgccgtttacgtgacatc

SEQ ID NO: 730369 - DNA, 25 bp, Artificial sequence
  Synthetic oligonucleotide
gtctaggtacgctcgtcatagtgac

SEQ ID NO: 730370 - DNA, 25 bp, Artificial sequence
  Synthetic oligonucleotide
gaagagcccggttcgtaaagtaagc

SEQ ID NO: 730371 - DNA, 25 bp, Artificial sequence
  Synthetic oligonucleotide
tccgaacctatagggcgcatatagc

SEQ ID NO: 730372 - DNA, 25 bp, Artificial sequence
  Synthetic oligonucleotide
gaagagcccggtacgtaaagtaagc

SEQ ID NO: 730373 - DNA, 25 bp, Artificial sequence
  Synthetic oligonucleotide
attgtgttcatcgcgctagctcggt

SEQ ID NO: 730374 - DNA, 25 bp, Artificial sequence
  Synthetic oligonucleotide
ctttcctaccgtttcgcgacatctg

SEQ ID NO: 730375 - DNA, 25 bp, Artificial sequence
  Synthetic oligonucleotide
attgtgttcatcccgctagctcggt

SEQ ID NO: 730376 - DNA, 25 bp, Artificial sequence
  Synthetic oligonucleotide
atctggaactcccgtacgctaaagg

SEQ ID NO: 730377 - DNA, 25 bp, Artificial sequence
  Synthetic oligonucleotide
agacataatagtggcgcccttgtcg

SEQ ID NO: 730378 - DNA, 25 bp, Artificial sequence
  Synthetic oligonucleotide
ctttcctaccgtatcgcgacatctg

SEQ ID NO: 730379 - DNA, 25 bp, Artificial sequence
  Synthetic oligonucleotide
tccgaacctatacggcgcatatagc

SEQ ID NO: 730380 - DNA, 25 bp, Artificial sequence
  Synthetic oligonucleotide
atctggaactccggtacgctaaagg

SEQ ID NO: 730381 - DNA, 25 bp, Artificial sequence
  Synthetic oligonucleotide
agacataatagtcgcgcccttgtcg

SEQ ID NO: 730382 - DNA, 25 bp, Artificial sequence
  Synthetic oligonucleotide
gacctgcggtacgagttagcatacg

SEQ ID NO: 730383 - DNA, 25 bp, Artificial sequence
  Synthetic oligonucleotide
aatcgatacgctcgtacggagccac

SEQ ID NO: 730384 - DNA, 25 bp, Artificial sequence
  Synthetic oligonucleotide
tggcttacgacccttgccttgacct

SEQ ID NO: 730385 - DNA, 25 bp, Artificial sequence
  Synthetic oligonucleotide
aatcgatacgctggtacggagccac

SEQ ID NO: 730386 - DNA, 25 bp, Artificial sequence
  Synthetic oligonucleotide
tcttcattatatggcgggcgcccag

SEQ ID NO: 730387 - DNA, 25 bp, Artificial sequence
  Synthetic oligonucleotide
tcttcattatatcgcgggcgcccag

SEQ ID NO: 730388 - DNA, 25 bp, Artificial sequence
  Synthetic oligonucleotide
tggcttacgaccgttgccttgacct

SEQ ID NO: 730389 - DNA, 25 bp, Artificial sequence
  Synthetic oligonucleotide
aatacccgccgttcgactagctgca

SEQ ID NO: 730390 - DNA, 25 bp, Artificial sequence
  Synthetic oligonucleotide
tcgtgggatactccgtacgatggag

SEQ ID NO: 730391 - DNA, 25 bp, Artificial sequence
  Synthetic oligonucleotide
aatacccgccgtacgactagctgca

SEQ ID NO: 730392 - DNA, 25 bp, Artificial sequence
  Synthetic oligonucleotide
gcatataggtatgcgtcgaccggac

SEQ ID NO: 730393 - DNA, 25 bp, Artificial sequence
  Synthetic oligonucleotide
ctcgggcgtgttgggtacctttaca

SEQ ID NO: 730394 - DNA, 25 bp, Artificial sequence
  Synthetic oligonucleotide
gcatataggtatccgtcgaccggac

SEQ ID NO: 730395 - DNA, 25 bp, Artificial sequence
  Synthetic oligonucleotide
ttgtctcgcgtagtccaaagcaccg

SEQ ID NO: 730396 - DNA, 25 bp, Artificial sequence
  Synthetic oligonucleotide
ttgtctcgcgtactccaaagcaccg

SEQ ID NO: 730397 - DNA, 25 bp, Artificial sequence
  Synthetic oligonucleotide
tcgtgggatactgcgtacgatggag

SEQ ID NO: 730398 - DNA, 25 bp, Artificial sequence
  Synthetic oligonucleotide
gacctgcggtaccagttagcatacg

SEQ ID NO: 730399 - DNA, 25 bp, Artificial sequence
  Synthetic oligonucleotide
cgaggccgacgtccgatcttttcaa

SEQ ID NO: 730400 - DNA, 25 bp, Artificial sequence
  Synthetic oligonucleotide
ctcatttacgacccggtatacgggg

SEQ ID NO: 730401 - DNA, 25 bp, Artificial sequence
  Synthetic oligonucleotide
ctcatttacgacgcggtatacgggg

SEQ ID NO: 730402 - DNA, 25 bp, Artificial sequence
  Synthetic oligonucleotide
gttacaggcgtattagacgccgtgc

SEQ ID NO: 730403 - DNA, 25 bp, Artificial sequence
  Synthetic oligonucleotide
gttacaggcgtaatagacgccgtgc

SEQ ID NO: 730404 - DNA, 25 bp, Artificial sequence
  Synthetic oligonucleotide
accgattcgacttcgtgcgttcagg

SEQ ID NO: 730405 - DNA, 25 bp, Artificial sequence
  Synthetic oligonucleotide
accgattcgactacgtgcgttcagg

SEQ ID NO: 730406 - DNA, 25 bp, Artificial sequence
  Synthetic oligonucleotide
tcgtaatcgtccctcggtaggcatc

SEQ ID NO: 730407 - DNA, 25 bp, Artificial sequence
  Synthetic oligonucleotide
ttgaagttcgcggggctagtcagtc

SEQ ID NO: 730408 - DNA, 25 bp, Artificial sequence
  Synthetic oligonucleotide
acgtgagttcgactagtcgctcgtg

SEQ ID NO: 730409 - DNA, 25 bp, Artificial sequence
  Synthetic oligonucleotide
gtagtcaagcgccggtacgagaaga

SEQ ID NO: 730410 - DNA, 25 bp, Artificial sequence
  Synthetic oligonucleotide
ctcgggcgtgttcggtacctttaca

SEQ ID NO: 730411 - DNA, 25 bp, Artificial sequence
  Synthetic oligonucleotide
gtaatccgtatagcggcaagtgccc

SEQ ID NO: 730412 - DNA, 25 bp, Artificial sequence
  Synthetic oligonucleotide
cgaggccgacgtgcgatcttttcaa

SEQ ID NO: 730413 - DNA, 25 bp, Artificial sequence
  Synthetic oligonucleotide
cgaatggcgaattcggacgttgcct

SEQ ID NO: 730414 - DNA, 25 bp, Artificial sequence
  Synthetic oligonucleotide
cgaatggcgaatacggacgttgcct

SEQ ID NO: 730415 - DNA, 25 bp, Artificial sequence
  Synthetic oligonucleotide
cccatacgtaggttggccgtgacat

SEQ ID NO: 730416 - DNA, 25 bp, Artificial sequence
  Synthetic oligonucleotide
ttgaagttcgcgcggctagtcagtc

SEQ ID NO: 730417 - DNA, 25 bp, Artificial sequence
  Synthetic oligonucleotide
tcgtaatcgtccgtcggtaggcatc

SEQ ID NO: 730418 - DNA, 25 bp, Artificial sequence
  Synthetic oligonucleotide
acgtgagttcgagtagtcgctcgtg

SEQ ID NO: 730419 - DNA, 25 bp, Artificial sequence
  Synthetic oligonucleotide
gtagtcaagcgcgggtacgagaaga

SEQ ID NO: 730420 - DNA, 25 bp, Artificial sequence
  Synthetic oligonucleotide
gggtcacgctagcccgattaagtca

SEQ ID NO: 730421 - DNA, 25 bp, Artificial sequence
  Synthetic oligonucleotide
tctttgcgcgtatgacgcaggctac

SEQ ID NO: 730422 - DNA, 25 bp, Artificial sequence
  Synthetic oligonucleotide
gcgctgattagtggcgcgatgaagt

SEQ ID NO: 730423 - DNA, 25 bp, Artificial sequence
  Synthetic oligonucleotide
gcgctgattagtcgcgcgatgaagt

SEQ ID NO: 730424 - DNA, 25 bp, Artificial sequence
  Synthetic oligonucleotide
agaggtcggtaccatgcgtagtgtg

SEQ ID NO: 730425 - DNA, 25 bp, Artificial sequence
  Synthetic oligonucleotide
agaggtcggtacgatgcgtagtgtg

SEQ ID NO: 730426 - DNA, 25 bp, Artificial sequence
  Synthetic oligonucleotide
cgtgtcgatcggggctttaacttgc

SEQ ID NO: 730427 - DNA, 25 bp, Artificial sequence
  Synthetic oligonucleotide
cgtgtcgatcggcgctttaacttgc

SEQ ID NO: 730428 - DNA, 25 bp, Artificial sequence
  Synthetic oligonucleotide
catttcccgtaaggcgcaatggtcc

SEQ ID NO: 730429 - DNA, 25 bp, Artificial sequence
  Synthetic oligonucleotide
tgtggatcgataggcggactcccat

SEQ ID NO: 730430 - DNA, 25 bp, Artificial sequence
  Synthetic oligonucleotide
gtgcgcgtacgaggctatacatacg

SEQ ID NO: 730431 - DNA, 25 bp, Artificial sequence
  Synthetic oligonucleotide
gggtcacgctaggccgattaagtca

SEQ ID NO: 730432 - DNA, 25 bp, Artificial sequence
  Synthetic oligonucleotide
ctggtgacgcggtctaatgacgtgt

SEQ ID NO: 730433 - DNA, 25 bp, Artificial sequence
  Synthetic oligonucleotide
ctggtgacgcggactaatgacgtgt

SEQ ID NO: 730434 - DNA, 25 bp, Artificial sequence
  Synthetic oligonucleotide
caactaatgtctaggcgcgacccca

SEQ ID NO: 730435 - DNA, 25 bp, Artificial sequence
  Synthetic oligonucleotide
cccatacgtaggatggccgtgacat

SEQ ID NO: 730436 - DNA, 25 bp, Artificial sequence
  Synthetic oligonucleotide
gcacccttctatcgcgagcctgtta

SEQ ID NO: 730437 - DNA, 25 bp, Artificial sequence
  Synthetic oligonucleotide
ccccttgttcgtacgcgattgaggt

SEQ ID NO: 730438 - DNA, 25 bp, Artificial sequence
  Synthetic oligonucleotide
caactaatgtcttggcgcgacccca

SEQ ID NO: 730439 - DNA, 25 bp, Artificial sequence
  Synthetic oligonucleotide
tgtggatcgatacgcggactcccat

SEQ ID NO: 730440 - DNA, 25 bp, Artificial sequence
  Synthetic oligonucleotide
accgtggtgtattcggtcggattcc

SEQ ID NO: 730441 - DNA, 25 bp, Artificial sequence
  Synthetic oligonucleotide
aacggtctcttagcgcggaaacgac

SEQ ID NO: 730442 - DNA, 25 bp, Artificial sequence
  Synthetic oligonucleotide
aacggtctcttaccgcggaaacgac

SEQ ID NO: 730443 - DNA, 25 bp, Artificial sequence
  Synthetic oligonucleotide
ctcaacctacgtgcgacgtcatcct

SEQ ID NO: 730444 - DNA, 25 bp, Artificial sequence
  Synthetic oligonucleotide
ctcaacctacgtccgacgtcatcct

SEQ ID NO: 730445 - DNA, 25 bp, Artificial sequence
  Synthetic oligonucleotide
gcatgtctgcgccaatagggtcaac

SEQ ID NO: 730446 - DNA, 25 bp, Artificial sequence
  Synthetic oligonucleotide
gcatgtctgcgcgaatagggtcaac

SEQ ID NO: 730447 - DNA, 25 bp, Artificial sequence
  Synthetic oligonucleotide
gactctctacgcgcgtctaggtttc

SEQ ID NO: 730448 - DNA, 25 bp, Artificial sequence
  Synthetic oligonucleotide
catttcccgtaacgcgcaatggtcc

SEQ ID NO: 730449 - DNA, 25 bp, Artificial sequence
  Synthetic oligonucleotide
accgtggtgtatacggtcggattcc

SEQ ID NO: 730450 - DNA, 25 bp, Artificial sequence
  Synthetic oligonucleotide
gtaatccgtataccggcaagtgccc

SEQ ID NO: 730451 - DNA, 25 bp, Artificial sequence
  Synthetic oligonucleotide
tctttgcgcgtaagacgcaggctac

SEQ ID NO: 730452 - DNA, 25 bp, Artificial sequence
  Synthetic oligonucleotide
tagactcgcgtttgacggttagcgg

SEQ ID NO: 730453 - DNA, 25 bp, Artificial sequence
  Synthetic oligonucleotide
tagactcgcgttagacggttagcgg

SEQ ID NO: 730454 - DNA, 25 bp, Artificial sequence
  Synthetic oligonucleotide
gtgggacgcaaggggatagttacag

SEQ ID NO: 730455 - DNA, 25 bp, Artificial sequence
  Synthetic oligonucleotide
gtgggacgcaagcggatagttacag

SEQ ID NO: 730456 - DNA, 25 bp, Artificial sequence
  Synthetic oligonucleotide
gcagcatcgcacgatatacgggtca

SEQ ID NO: 730457 - DNA, 25 bp, Artificial sequence
  Synthetic oligonucleotide
gcagcatcgcaccatatacgggtca

SEQ ID NO: 730458 - DNA, 25 bp, Artificial sequence
  Synthetic oligonucleotide
gtgcgcgtacgacgctatacatacg

SEQ ID NO: 730459 - DNA, 25 bp, Artificial sequence
  Synthetic oligonucleotide
gactctctacgcccgtctaggtttc

SEQ ID NO: 730460 - DNA, 25 bp, Artificial sequence
  Synthetic oligonucleotide
gctgtacgattcgcgcataacgggt

SEQ ID NO: 730461 - DNA, 25 bp, Artificial sequence
  Synthetic oligonucleotide
gtcgtgatagcgtcgcgcacatatg

SEQ ID NO: 730462 - DNA, 25 bp, Artificial sequence
  Synthetic oligonucleotide
aggcaccgcgacccgtatgattact

SEQ ID NO: 730463 - DNA, 25 bp, Artificial sequence
  Synthetic oligonucleotide
ctaatctcgtaaggtgctcacggcc

SEQ ID NO: 730464 - DNA, 25 bp, Artificial sequence
  Synthetic oligonucleotide
ctgcactcggcgcgacataaccatt

SEQ ID NO: 730465 - DNA, 25 bp, Artificial sequence
  Synthetic oligonucleotide
ctgcactcggcgggacataaccatt

SEQ ID NO: 730466 - DNA, 25 bp, Artificial sequence
  Synthetic oligonucleotide
cttttagcgacgcgttgatggtccc

SEQ ID NO: 730467 - DNA, 25 bp, Artificial sequence
  Synthetic oligonucleotide
cttttagcgacgggttgatggtccc

SEQ ID NO: 730468 - DNA, 25 bp, Artificial sequence
  Synthetic oligonucleotide
tccggaacacgcggtatcgaactca

SEQ ID NO: 730469 - DNA, 25 bp, Artificial sequence
  Synthetic oligonucleotide
tccggaacacgccgtatcgaactca

SEQ ID NO: 730470 - DNA, 25 bp, Artificial sequence
  Synthetic oligonucleotide
ccaatcacggattaccgggtgtctc

SEQ ID NO: 730471 - DNA, 25 bp, Artificial sequence
  Synthetic oligonucleotide
ttgagttacgctcgagcgatggacg

SEQ ID NO: 730472 - DNA, 25 bp, Artificial sequence
  Synthetic oligonucleotide
agaagcacacgttacgcggtgcttg

SEQ ID NO: 730473 - DNA, 25 bp, Artificial sequence
  Synthetic oligonucleotide
gctgtacgattcccgcataacgggt

SEQ ID NO: 730474 - DNA, 25 bp, Artificial sequence
  Synthetic oligonucleotide
ccacgatactaacgacgcgacccta

SEQ ID NO: 730475 - DNA, 25 bp, Artificial sequence
  Synthetic oligonucleotide
ccacgatactaaggacgcgacccta

SEQ ID NO: 730476 - DNA, 25 bp, Artificial sequence
  Synthetic oligonucleotide
ccccttgttcgttcgcgattgaggt

SEQ ID NO: 730477 - DNA, 25 bp, Artificial sequence
  Synthetic oligonucleotide
gtcgtgatagcgacgcgcacatatg

SEQ ID NO: 730478 - DNA, 25 bp, Artificial sequence
  Synthetic oligonucleotide
aggccaaccgcgcgttagatgaaag

SEQ ID NO: 730479 - DNA, 25 bp, Artificial sequence
  Synthetic oligonucleotide
aggccaaccgcgggttagatgaaag

SEQ ID NO: 730480 - DNA, 25 bp, Artificial sequence
  Synthetic oligonucleotide
agggcaatatcgcgacgggaaagga

SEQ ID NO: 730481 - DNA, 25 bp, Artificial sequence
  Synthetic oligonucleotide
agggcaatatcgggacgggaaagga

SEQ ID NO: 730482 - DNA, 25 bp, Artificial sequence
  Synthetic oligonucleotide
ttgagttacgctggagcgatggacg

SEQ ID NO: 730483 - DNA, 25 bp, Artificial sequence
  Synthetic oligonucleotide
ggaaggtcgtattgacgctgcagtc

SEQ ID NO: 730484 - DNA, 25 bp, Artificial sequence
  Synthetic oligonucleotide
ctaatctcgtaacgtgctcacggcc

SEQ ID NO: 730485 - DNA, 25 bp, Artificial sequence
  Synthetic oligonucleotide
gcacccttctatggcgagcctgtta

SEQ ID NO: 730486 - DNA, 25 bp, Artificial sequence
  Synthetic oligonucleotide
ccgcatctcgcgcgaatagcactat

SEQ ID NO: 730487 - DNA, 25 bp, Artificial sequence
  Synthetic oligonucleotide
ccgcatctcgcgggaatagcactat

SEQ ID NO: 730488 - DNA, 25 bp, Artificial sequence
  Synthetic oligonucleotide
gtttcgggcatatcacgcgctactg

SEQ ID NO: 730489 - DNA, 25 bp, Artificial sequence
  Synthetic oligonucleotide
gtttcgggcataacacgcgctactg

SEQ ID NO: 730490 - DNA, 25 bp, Artificial sequence
  Synthetic oligonucleotide
taggcccgtcacgcgtagaaacaac

SEQ ID NO: 730491 - DNA, 25 bp, Artificial sequence
  Synthetic oligonucleotide
taggcccgtcacccgtagaaacaac

SEQ ID NO: 730492 - DNA, 25 bp, Artificial sequence
  Synthetic oligonucleotide
acagagatgcgggttcggtagccaa

SEQ ID NO: 730493 - DNA, 25 bp, Artificial sequence
  Synthetic oligonucleotide
ccaatcacggataaccgggtgtctc

SEQ ID NO: 730494 - DNA, 25 bp, Artificial sequence
  Synthetic oligonucleotide
ggaaggtcgtatagacgctgcagtc

SEQ ID NO: 730495 - DNA, 25 bp, Artificial sequence
  Synthetic oligonucleotide
tctccgttgtctggcgacatgacct

SEQ ID NO: 730496 - DNA, 25 bp, Artificial sequence
  Synthetic oligonucleotide
atatgtcacgatatacgcgcgcggc

SEQ ID NO: 730497 - DNA, 25 bp, Artificial sequence
  Synthetic oligonucleotide
atatgtcacgatttacgcgcgcggc

SEQ ID NO: 730498 - DNA, 25 bp, Artificial sequence
  Synthetic oligonucleotide
ccctatggtacctaacgcgttggct

SEQ ID NO: 730499 - DNA, 25 bp, Artificial sequence
  Synthetic oligonucleotide
ccctatggtaccaaacgcgttggct

SEQ ID NO: 730500 - DNA, 25 bp, Artificial sequence
  Synthetic oligonucleotide
cagacgttagacccgacgtcgtcaa

SEQ ID NO: 730501 - DNA, 25 bp, Artificial sequence
  Synthetic oligonucleotide
cagacgttagacgcgacgtcgtcaa

SEQ ID NO: 730502 - DNA, 25 bp, Artificial sequence
  Synthetic oligonucleotide
ctgtggacccgcgattcgtgatttc

SEQ ID NO: 730503 - DNA, 25 bp, Artificial sequence
  Synthetic oligonucleotide
ctgtggacccgccattcgtgatttc

SEQ ID NO: 730504 - DNA, 25 bp, Artificial sequence
  Synthetic oligonucleotide
agaagcacacgtaacgcggtgcttg

SEQ ID NO: 730505 - DNA, 25 bp, Artificial sequence
  Synthetic oligonucleotide
acagagatgcggcttcggtagccaa

SEQ ID NO: 730506 - DNA, 25 bp, Artificial sequence
  Synthetic oligonucleotide
ctaccggactagttccgcggaatag

SEQ ID NO: 730507 - DNA, 25 bp, Artificial sequence
  Synthetic oligonucleotide
cttagcgcgtaagggtcgtacaagc

SEQ ID NO: 730508 - DNA, 25 bp, Artificial sequence
  Synthetic oligonucleotide
cttagcgcgtaacggtcgtacaagc

SEQ ID NO: 730509 - DNA, 25 bp, Artificial sequence
  Synthetic oligonucleotide
cattactgttatcggaccgcgaggg

SEQ ID NO: 730510 - DNA, 25 bp, Artificial sequence
  Synthetic oligonucleotide
cattactgttatgggaccgcgaggg

SEQ ID NO: 730511 - DNA, 25 bp, Artificial sequence
  Synthetic oligonucleotide
tctgatgtaacgtagcgcggcctca

SEQ ID NO: 730512 - DNA, 25 bp, Artificial sequence
  Synthetic oligonucleotide
tctgatgtaacgaagcgcggcctca

SEQ ID NO: 730513 - DNA, 25 bp, Artificial sequence
  Synthetic oligonucleotide
gtatggcgctatacgaacctgtgcg

SEQ ID NO: 730514 - DNA, 25 bp, Artificial sequence
  Synthetic oligonucleotide
gtatggcgctattcgaacctgtgcg

SEQ ID NO: 730515 - DNA, 25 bp, Artificial sequence
  Synthetic oligonucleotide
cggtgtatatcgggtccggcatagt

SEQ ID NO: 730516 - DNA, 25 bp, Artificial sequence
  Synthetic oligonucleotide
ctgctcccgtactatcgtgtgaacg

SEQ ID NO: 730517 - DNA, 25 bp, Artificial sequence
  Synthetic oligonucleotide
ctaccggactagatccgcggaatag

SEQ ID NO: 730518 - DNA, 25 bp, Artificial sequence
  Synthetic oligonucleotide
tgggaacgaagttacgcggtcacga

SEQ ID NO: 730519 - DNA, 25 bp, Artificial sequence
  Synthetic oligonucleotide
agcagccgtcggttctcgtgataga

SEQ ID NO: 730520 - DNA, 25 bp, Artificial sequence
  Synthetic oligonucleotide
agcagccgtcggatctcgtgataga

SEQ ID NO: 730521 - DNA, 25 bp, Artificial sequence
  Synthetic oligonucleotide
aatcgccccgtcggattcgttgtac

SEQ ID NO: 730522 - DNA, 25 bp, Artificial sequence
  Synthetic oligonucleotide
aatcgccccgtccgattcgttgtac

SEQ ID NO: 730523 - DNA, 25 bp, Artificial sequence
  Synthetic oligonucleotide
aggccaaggtcgtcgtacgcttatg

SEQ ID NO: 730524 - DNA, 25 bp, Artificial sequence
  Synthetic oligonucleotide
aggccaaggtcgacgtacgcttatg

SEQ ID NO: 730525 - DNA, 25 bp, Artificial sequence
  Synthetic oligonucleotide
ttagagacgggaggtatcggtaccc

SEQ ID NO: 730526 - DNA, 25 bp, Artificial sequence
  Synthetic oligonucleotide
ttagagacgggacgtatcggtaccc

SEQ ID NO: 730527 - DNA, 25 bp, Artificial sequence
  Synthetic oligonucleotide
cattggacgcgaaccgtagttacgg

SEQ ID NO: 730528 - DNA, 25 bp, Artificial sequence
  Synthetic oligonucleotide
cggtgtatatcgcgtccggcatagt

SEQ ID NO: 730529 - DNA, 25 bp, Artificial sequence
  Synthetic oligonucleotide
cgaacgatagcgctaaccgagccat

SEQ ID NO: 730530 - DNA, 25 bp, Artificial sequence
  Synthetic oligonucleotide
cattggacgcgatccgtagttacgg

SEQ ID NO: 730531 - DNA, 25 bp, Artificial sequence
  Synthetic oligonucleotide
tctccgttgtctcgcgacatgacct

SEQ ID NO: 730532 - DNA, 25 bp, Artificial sequence
  Synthetic oligonucleotide
tcccaagttaccccccgtagctctt

SEQ ID NO: 730533 - DNA, 25 bp, Artificial sequence
  Synthetic oligonucleotide
tcccaagttaccgcccgtagctctt

SEQ ID NO: 730534 - DNA, 25 bp, Artificial sequence
  Synthetic oligonucleotide
atcaagcgcgattcggcaaggcgat

SEQ ID NO: 730535 - DNA, 25 bp, Artificial sequence
  Synthetic oligonucleotide
atcaagcgcgatacggcaaggcgat

SEQ ID NO: 730536 - DNA, 25 bp, Artificial sequence
  Synthetic oligonucleotide
acatcatcttaccagcggcagaggc

SEQ ID NO: 730537 - DNA, 25 bp, Artificial sequence
  Synthetic oligonucleotide
acatcatcttacgagcggcagaggc

SEQ ID NO: 730538 - DNA, 25 bp, Artificial sequence
  Synthetic oligonucleotide
gcccatgtactggtacgcgtatcag

SEQ ID NO: 730539 - DNA, 25 bp, Artificial sequence
  Synthetic oligonucleotide
agccctgacccgttacgaggtagta

SEQ ID NO: 730540 - DNA, 25 bp, Artificial sequence
  Synthetic oligonucleotide
cgaacgatagcggtaaccgagccat

SEQ ID NO: 730541 - DNA, 25 bp, Artificial sequence
  Synthetic oligonucleotide
agccctgacccgatacgaggtagta

SEQ ID NO: 730542 - DNA, 25 bp, Artificial sequence
  Synthetic oligonucleotide
ctccaaagactatcgcgctccaacg

SEQ ID NO: 730543 - DNA, 25 bp, Artificial sequence
  Synthetic oligonucleotide
ctccaaagactaacgcgctccaacg

SEQ ID NO: 730544 - DNA, 25 bp, Artificial sequence
  Synthetic oligonucleotide
tcgtattcgtcattccgcgtgccga

SEQ ID NO: 730545 - DNA, 25 bp, Artificial sequence
  Synthetic oligonucleotide
tcgtattcgtcaatccgcgtgccga

SEQ ID NO: 730546 - DNA, 25 bp, Artificial sequence
  Synthetic oligonucleotide
tgcctaccgtgcgttcgaagacgta

SEQ ID NO: 730547 - DNA, 25 bp, Artificial sequence
  Synthetic oligonucleotide
tgcctaccgtgccttcgaagacgta

SEQ ID NO: 730548 - DNA, 25 bp, Artificial sequence
  Synthetic oligonucleotide
aagggaataacgtcggacgcccatg

SEQ ID NO: 730549 - DNA, 25 bp, Artificial sequence
  Synthetic oligonucleotide
aagggaataacgacggacgcccatg

SEQ ID NO: 730550 - DNA, 25 bp, Artificial sequence
  Synthetic oligonucleotide
tgggaacgaagtaacgcggtcacga

SEQ ID NO: 730551 - DNA, 25 bp, Artificial sequence
  Synthetic oligonucleotide
ctgctcccgtacaatcgtgtgaacg

SEQ ID NO: 730552 - DNA, 25 bp, Artificial sequence
  Synthetic oligonucleotide
gcccatgtactgctacgcgtatcag

SEQ ID NO: 730553 - DNA, 25 bp, Artificial sequence
  Synthetic oligonucleotide
ctgtgtccgcattagtccgatgcct

SEQ ID NO: 730554 - DNA, 25 bp, Artificial sequence
  Synthetic oligonucleotide
tgctgaagtacgcttcgtctcagcg

SEQ ID NO: 730555 - DNA, 25 bp, Artificial sequence
  Synthetic oligonucleotide
atgctgcgattactacccgcggagt

SEQ ID NO: 730556 - DNA, 25 bp, Artificial sequence
  Synthetic oligonucleotide
atgctgcgattagtacccgcggagt

SEQ ID NO: 730557 - DNA, 25 bp, Artificial sequence
  Synthetic oligonucleotide
ttgggcatatgccgttccgacggaa

SEQ ID NO: 730558 - DNA, 25 bp, Artificial sequence
  Synthetic oligonucleotide
ttgggcatatgcggttccgacggaa

SEQ ID NO: 730559 - DNA, 25 bp, Artificial sequence
  Synthetic oligonucleotide
cggtagtcgcgtcgtaacgagacaa

SEQ ID NO: 730560 - DNA, 25 bp, Artificial sequence
  Synthetic oligonucleotide
cggtagtcgcgtggtaacgagacaa

SEQ ID NO: 730561 - DNA, 25 bp, Artificial sequence
  Synthetic oligonucleotide
acaaaagtacgccctcgtcagagcg

SEQ ID NO: 730562 - DNA, 25 bp, Artificial sequence
  Synthetic oligonucleotide
acaaaagtacgcgctcgtcagagcg

SEQ ID NO: 730563 - DNA, 25 bp, Artificial sequence
  Synthetic oligonucleotide
ggatagactctaacgcggcactagc

SEQ ID NO: 730564 - DNA, 25 bp, Artificial sequence
  Synthetic oligonucleotide
ggatagactctatcgcggcactagc

SEQ ID NO: 730565 - DNA, 25 bp, Artificial sequence
  Synthetic oligonucleotide
cgcacacttcgacccgtattcgtag

SEQ ID NO: 730566 - DNA, 25 bp, Artificial sequence
  Synthetic oligonucleotide
cgaattcggatacggtctagcgcct

SEQ ID NO: 730567 - DNA, 25 bp, Artificial sequence
  Synthetic oligonucleotide
acaccgccggtcgtcacaaaatgag

SEQ ID NO: 730568 - DNA, 25 bp, Artificial sequence
  Synthetic oligonucleotide
ctgtgtccgcataagtccgatgcct

SEQ ID NO: 730569 - DNA, 25 bp, Artificial sequence
  Synthetic oligonucleotide
agttgatatcgcaagtgcggggctg

SEQ ID NO: 730570 - DNA, 25 bp, Artificial sequence
  Synthetic oligonucleotide
agttgatatcgctagtgcggggctg

SEQ ID NO: 730571 - DNA, 25 bp, Artificial sequence
  Synthetic oligonucleotide
ggctaaggaccgatatgcgtggcaa

SEQ ID NO: 730572 - DNA, 25 bp, Artificial sequence
  Synthetic oligonucleotide
ggctaaggaccgttatgcgtggcaa

SEQ ID NO: 730573 - DNA, 25 bp, Artificial sequence
  Synthetic oligonucleotide
gttagacgcgcgaattaggctccct

SEQ ID NO: 730574 - DNA, 25 bp, Artificial sequence
  Synthetic oligonucleotide
gttagacgcgcgtattaggctccct

SEQ ID NO: 730575 - DNA, 25 bp, Artificial sequence
  Synthetic oligonucleotide
ccggccattggtacgcgaaagagtt

SEQ ID NO: 730576 - DNA, 25 bp, Artificial sequence
  Synthetic oligonucleotide
ccggccattggttcgcgaaagagtt

SEQ ID NO: 730577 - DNA, 25 bp, Artificial sequence
  Synthetic oligonucleotide
gagtggtagtcggcgtacgattgca

SEQ ID NO: 730578 - DNA, 25 bp, Artificial sequence
  Synthetic oligonucleotide
gagtggtagtcgccgtacgattgca

SEQ ID NO: 730579 - DNA, 25 bp, Artificial sequence
  Synthetic oligonucleotide
gcacggacccgcgagtaatagcttt

SEQ ID NO: 730580 - DNA, 25 bp, Artificial sequence
  Synthetic oligonucleotide
cgaattcggatagggtctagcgcct

SEQ ID NO: 730581 - DNA, 25 bp, Artificial sequence
  Synthetic oligonucleotide
ttgtaatacggacccgctaggtcgg

SEQ ID NO: 730582 - DNA, 25 bp, Artificial sequence
  Synthetic oligonucleotide
tggtatcggcgtcaatcgtgtggtg

SEQ ID NO: 730583 - DNA, 25 bp, Artificial sequence
  Synthetic oligonucleotide
tggtatcggcgtgaatcgtgtggtg

SEQ ID NO: 730584 - DNA, 25 bp, Artificial sequence
  Synthetic oligonucleotide
tcgaggggtaacctaccgctcttac

SEQ ID NO: 730585 - DNA, 25 bp, Artificial sequence
  Synthetic oligonucleotide
tcgaggggtaacgtaccgctcttac

SEQ ID NO: 730586 - DNA, 25 bp, Artificial sequence
  Synthetic oligonucleotide
gatatgcatgtccggttcgaggtgc

SEQ ID NO: 730587 - DNA, 25 bp, Artificial sequence
  Synthetic oligonucleotide
gatatgcatgtcgggttcgaggtgc

SEQ ID NO: 730588 - DNA, 25 bp, Artificial sequence
  Synthetic oligonucleotide
tcctcctcgtaagccgcaaagtgga

SEQ ID NO: 730589 - DNA, 25 bp, Artificial sequence
  Synthetic oligonucleotide
tcctcctcgtaacccgcaaagtgga

SEQ ID NO: 730590 - DNA, 25 bp, Artificial sequence
  Synthetic oligonucleotide
tcttcagatacgggcccgtctatgg

SEQ ID NO: 730591 - DNA, 25 bp, Artificial sequence
  Synthetic oligonucleotide
tcttcagatacgcgcccgtctatgg

SEQ ID NO: 730592 - DNA, 25 bp, Artificial sequence
  Synthetic oligonucleotide
gtcaggcgcacgttcgaaacgcaat

SEQ ID NO: 730593 - DNA, 25 bp, Artificial sequence
  Synthetic oligonucleotide
gtcaggcgcacgatcgaaacgcaat

SEQ ID NO: 730594 - DNA, 25 bp, Artificial sequence
  Synthetic oligonucleotide
tgctgaagtacggttcgtctcagcg

SEQ ID NO: 730595 - DNA, 25 bp, Artificial sequence
  Synthetic oligonucleotide
cgaaggtaactcgcgaagtacgcca

SEQ ID NO: 730596 - DNA, 25 bp, Artificial sequence
  Synthetic oligonucleotide
acaccgccggtcctcacaaaatgag

SEQ ID NO: 730597 - DNA, 25 bp, Artificial sequence
  Synthetic oligonucleotide
ttgtaatacggagccgctaggtcgg

SEQ ID NO: 730598 - DNA, 25 bp, Artificial sequence
  Synthetic oligonucleotide
atcagatacgtcggttaccgcccac

SEQ ID NO: 730599 - DNA, 25 bp, Artificial sequence
  Synthetic oligonucleotide
atcagatacgtccgttaccgcccac

SEQ ID NO: 730600 - DNA, 25 bp, Artificial sequence
  Synthetic oligonucleotide
ggacaccgtgcgttagacgatgttg

SEQ ID NO: 730601 - DNA, 25 bp, Artificial sequence
  Synthetic oligonucleotide
ggacaccgtgcgatagacgatgttg

SEQ ID NO: 730602 - DNA, 25 bp, Artificial sequence
  Synthetic oligonucleotide
aacacccgccgttcgaactctagtc

SEQ ID NO: 730603 - DNA, 25 bp, Artificial sequence
  Synthetic oligonucleotide
aacacccgccgtacgaactctagtc

SEQ ID NO: 730604 - DNA, 25 bp, Artificial sequence
  Synthetic oligonucleotide
tacatgccggtcgtttaggtgctgg

SEQ ID NO: 730605 - DNA, 25 bp, Artificial sequence
  Synthetic oligonucleotide
tacatgccggtcctttaggtgctgg

SEQ ID NO: 730606 - DNA, 25 bp, Artificial sequence
  Synthetic oligonucleotide
ttggggcgtaaccgacgctcattgt

SEQ ID NO: 730607 - DNA, 25 bp, Artificial sequence
  Synthetic oligonucleotide
ttggggcgtaacggacgctcattgt

SEQ ID NO: 730608 - DNA, 25 bp, Artificial sequence
  Synthetic oligonucleotide
cgttttgcggattggtcggcggtaa

SEQ ID NO: 730609 - DNA, 25 bp, Artificial sequence
  Synthetic oligonucleotide
cgaaggtaactcccgaagtacgcca

SEQ ID NO: 730610 - DNA, 25 bp, Artificial sequence
  Synthetic oligonucleotide
gagacgcgcgagcatagacagattc

SEQ ID NO: 730611 - DNA, 25 bp, Artificial sequence
  Synthetic oligonucleotide
acgcagatcggcctatcgctatgga

SEQ ID NO: 730612 - DNA, 25 bp, Artificial sequence
  Synthetic oligonucleotide
ctcaccatagtcctaccggcttgtg

SEQ ID NO: 730613 - DNA, 25 bp, Artificial sequence
  Synthetic oligonucleotide
ctcaccatagtcgtaccggcttgtg

SEQ ID NO: 730614 - DNA, 25 bp, Artificial sequence
  Synthetic oligonucleotide
tgtgttgcgcgatacgacttccgct

SEQ ID NO: 730615 - DNA, 25 bp, Artificial sequence
  Synthetic oligonucleotide
gcatcaactcggtacgtcgcagaag

SEQ ID NO: 730616 - DNA, 25 bp, Artificial sequence
  Synthetic oligonucleotide
agtttccgcacgtacggtctctacg

SEQ ID NO: 730617 - DNA, 25 bp, Artificial sequence
  Synthetic oligonucleotide
agtttccgcacgaacggtctctacg

SEQ ID NO: 730618 - DNA, 25 bp, Artificial sequence
  Synthetic oligonucleotide
gtaggacatgtttcgagcgacgtgc

SEQ ID NO: 730619 - DNA, 25 bp, Artificial sequence
  Synthetic oligonucleotide
gtaggacatgttacgagcgacgtgc

SEQ ID NO: 730620 - DNA, 25 bp, Artificial sequence
  Synthetic oligonucleotide
gagtgaattacggcggaccagctga

SEQ ID NO: 730621 - DNA, 25 bp, Artificial sequence
  Synthetic oligonucleotide
gttaggagcgcctatcgagtcgtct

SEQ ID NO: 730622 - DNA, 25 bp, Artificial sequence
  Synthetic oligonucleotide
cgcacacttcgagccgtattcgtag

SEQ ID NO: 730623 - DNA, 25 bp, Artificial sequence
  Synthetic oligonucleotide
gagtgaattacgccggaccagctga

SEQ ID NO: 730624 - DNA, 25 bp, Artificial sequence
  Synthetic oligonucleotide
atagtctgcgtacgagacgccgtac

SEQ ID NO: 730625 - DNA, 25 bp, Artificial sequence
  Synthetic oligonucleotide
gagacgcgcgaggatagacagattc

SEQ ID NO: 730626 - DNA, 25 bp, Artificial sequence
  Synthetic oligonucleotide
cataccacgtgacgcggtattgacc

SEQ ID NO: 730627 - DNA, 25 bp, Artificial sequence
  Synthetic oligonucleotide
cataccacgtgaggcggtattgacc

SEQ ID NO: 730628 - DNA, 25 bp, Artificial sequence
  Synthetic oligonucleotide
ctcatgcggcgtactcttaccgatc

SEQ ID NO: 730629 - DNA, 25 bp, Artificial sequence
  Synthetic oligonucleotide
ctcatgcggcgttctcttaccgatc

SEQ ID NO: 730630 - DNA, 25 bp, Artificial sequence
  Synthetic oligonucleotide
atatctcgtacgagcgttctgcccg

SEQ ID NO: 730631 - DNA, 25 bp, Artificial sequence
  Synthetic oligonucleotide
atatctcgtacgtgcgttctgcccg

SEQ ID NO: 730632 - DNA, 25 bp, Artificial sequence
  Synthetic oligonucleotide
aagcggccggtaggctaatacccat

SEQ ID NO: 730633 - DNA, 25 bp, Artificial sequence
  Synthetic oligonucleotide
aagcggccggtacgctaatacccat

SEQ ID NO: 730634 - DNA, 25 bp, Artificial sequence
  Synthetic oligonucleotide
ccctacgtctcgaacgcgaatttgc

SEQ ID NO: 730635 - DNA, 25 bp, Artificial sequence
  Synthetic oligonucleotide
ccctacgtctcgtacgcgaatttgc

SEQ ID NO: 730636 - DNA, 25 bp, Artificial sequence
  Synthetic oligonucleotide
ccttgtcgacgcattactacccctc

SEQ ID NO: 730637 - DNA, 25 bp, Artificial sequence
  Synthetic oligonucleotide
aggcaccgcgacgcgtatgattact

SEQ ID NO: 730638 - DNA, 25 bp, Artificial sequence
  Synthetic oligonucleotide
ctcgtccctaccgatagcgtatcac

SEQ ID NO: 730639 - DNA, 25 bp, Artificial sequence
  Synthetic oligonucleotide
cgttttgcggataggtcggcggtaa

SEQ ID NO: 730640 - DNA, 25 bp, Artificial sequence
  Synthetic oligonucleotide
tgccactatcgctcgccgacgattt

SEQ ID NO: 730641 - DNA, 25 bp, Artificial sequence
  Synthetic oligonucleotide
tgccactatcgcacgccgacgattt

SEQ ID NO: 730642 - DNA, 25 bp, Artificial sequence
  Synthetic oligonucleotide
agcgtgtattatcgcgcccccaagt

SEQ ID NO: 730643 - DNA, 25 bp, Artificial sequence
  Synthetic oligonucleotide
agcgtgtattatggcgcccccaagt

SEQ ID NO: 730644 - DNA, 25 bp, Artificial sequence
  Synthetic oligonucleotide
tttgccccgcgtggtctataacctg

SEQ ID NO: 730645 - DNA, 25 bp, Artificial sequence
  Synthetic oligonucleotide
tttgccccgcgtcgtctataacctg

SEQ ID NO: 730646 - DNA, 25 bp, Artificial sequence
  Synthetic oligonucleotide
aacagtcgtcgttacacgcctaccc

SEQ ID NO: 730647 - DNA, 25 bp, Artificial sequence
  Synthetic oligonucleotide
aacagtcgtcgtaacacgcctaccc

SEQ ID NO: 730648 - DNA, 25 bp, Artificial sequence
  Synthetic oligonucleotide
gaagatcgagtatcgcgctcaggtg

SEQ ID NO: 730649 - DNA, 25 bp, Artificial sequence
  Synthetic oligonucleotide
gaagatcgagtaacgcgctcaggtg

SEQ ID NO: 730650 - DNA, 25 bp, Artificial sequence
  Synthetic oligonucleotide
acaggcgttaccccgcgtaatgttc

SEQ ID NO: 730651 - DNA, 25 bp, Artificial sequence
  Synthetic oligonucleotide
acgcagatcggcgtatcgctatgga

SEQ ID NO: 730652 - DNA, 25 bp, Artificial sequence
  Synthetic oligonucleotide
ctcgtccctacccatagcgtatcac

SEQ ID NO: 730653 - DNA, 25 bp, Artificial sequence
  Synthetic oligonucleotide
ccttgtcgacgctttactacccctc

SEQ ID NO: 730654 - DNA, 25 bp, Artificial sequence
  Synthetic oligonucleotide
agcctgaccgttttgccgccaattg

SEQ ID NO: 730655 - DNA, 25 bp, Artificial sequence
  Synthetic oligonucleotide
agcctgaccgttatgccgccaattg

SEQ ID NO: 730656 - DNA, 25 bp, Artificial sequence
  Synthetic oligonucleotide
ctgatcacgataccccccgtgttag

SEQ ID NO: 730657 - DNA, 25 bp, Artificial sequence
  Synthetic oligonucleotide
ctgatcacgatagcccccgtgttag

SEQ ID NO: 730658 - DNA, 25 bp, Artificial sequence
  Synthetic oligonucleotide
tcaaccaacggctcgtacgtagtcc

SEQ ID NO: 730659 - DNA, 25 bp, Artificial sequence
  Synthetic oligonucleotide
tcaaccaacggcacgtacgtagtcc

SEQ ID NO: 730660 - DNA, 25 bp, Artificial sequence
  Synthetic oligonucleotide
gcgggtcgtactataccgggcaatt

SEQ ID NO: 730661 - DNA, 25 bp, Artificial sequence
  Synthetic oligonucleotide
gcgggtcgtactttaccgggcaatt

SEQ ID NO: 730662 - DNA, 25 bp, Artificial sequence
  Synthetic oligonucleotide
agacattcggtcatcgcgttagccc

SEQ ID NO: 730663 - DNA, 25 bp, Artificial sequence
  Synthetic oligonucleotide
agacattcggtcttcgcgttagccc

SEQ ID NO: 730664 - DNA, 25 bp, Artificial sequence
  Synthetic oligonucleotide
atagtctgcgtaggagacgccgtac

SEQ ID NO: 730665 - DNA, 25 bp, Artificial sequence
  Synthetic oligonucleotide
tgtgttgcgcgaaacgacttccgct

SEQ ID NO: 730666 - DNA, 25 bp, Artificial sequence
  Synthetic oligonucleotide
acaggcgttaccgcgcgtaatgttc

SEQ ID NO: 730667 - DNA, 25 bp, Artificial sequence
  Synthetic oligonucleotide
cgtatggttgcgtctacgtcgggaa

SEQ ID NO: 730668 - DNA, 25 bp, Artificial sequence
  Synthetic oligonucleotide
cgtcacaaacgcgcgataggagaga

SEQ ID NO: 730669 - DNA, 25 bp, Artificial sequence
  Synthetic oligonucleotide
caaacagtcatcacgcgaacgccac

SEQ ID NO: 730670 - DNA, 25 bp, Artificial sequence
  Synthetic oligonucleotide
caaacagtcatctcgcgaacgccac

SEQ ID NO: 730671 - DNA, 25 bp, Artificial sequence
  Synthetic oligonucleotide
gagtacattacccccgcgtacgcta

SEQ ID NO: 730672 - DNA, 25 bp, Artificial sequence
  Synthetic oligonucleotide
gagtacattaccgccgcgtacgcta

SEQ ID NO: 730673 - DNA, 25 bp, Artificial sequence
  Synthetic oligonucleotide
cgttcgtgcgtttagaccgtgctga

SEQ ID NO: 730674 - DNA, 25 bp, Artificial sequence
  Synthetic oligonucleotide
gtgcgtatagcgccattcgtgtgga

SEQ ID NO: 730675 - DNA, 25 bp, Artificial sequence
  Synthetic oligonucleotide
cacgcaaacctatcgccgatggtca

SEQ ID NO: 730676 - DNA, 25 bp, Artificial sequence
  Synthetic oligonucleotide
tgtactgggttatccgcgtgatccc

SEQ ID NO: 730677 - DNA, 25 bp, Artificial sequence
  Synthetic oligonucleotide
tgtactgggttaaccgcgtgatccc

SEQ ID NO: 730678 - DNA, 25 bp, Artificial sequence
  Synthetic oligonucleotide
tcaggggcgcgtgacgtatagtatc

SEQ ID NO: 730679 - DNA, 25 bp, Artificial sequence
  Synthetic oligonucleotide
acagccttagcgttacgggcaagtg

SEQ ID NO: 730680 - DNA, 25 bp, Artificial sequence
  Synthetic oligonucleotide
cgtatggttgcgactacgtcgggaa

SEQ ID NO: 730681 - DNA, 25 bp, Artificial sequence
  Synthetic oligonucleotide
cctatgcctagtacgtcgaccccaa

SEQ ID NO: 730682 - DNA, 25 bp, Artificial sequence
  Synthetic oligonucleotide
gtaagggaattacgcgtcgtcggag

SEQ ID NO: 730683 - DNA, 25 bp, Artificial sequence
  Synthetic oligonucleotide
gtaagggaattaggcgtcgtcggag

SEQ ID NO: 730684 - DNA, 25 bp, Artificial sequence
  Synthetic oligonucleotide
tctagctccgacgtacctaagtcgc

SEQ ID NO: 730685 - DNA, 25 bp, Artificial sequence
  Synthetic oligonucleotide
tctagctccgacctacctaagtcgc

SEQ ID NO: 730686 - DNA, 25 bp, Artificial sequence
  Synthetic oligonucleotide
cgtagtgtccgcgcaaaacacccaa

SEQ ID NO: 730687 - DNA, 25 bp, Artificial sequence
  Synthetic oligonucleotide
cgtagtgtccgcccaaaacacccaa

SEQ ID NO: 730688 - DNA, 25 bp, Artificial sequence
  Synthetic oligonucleotide
tgcttatgcgcgataccgttgtcgc

SEQ ID NO: 730689 - DNA, 25 bp, Artificial sequence
  Synthetic oligonucleotide
tgcttatgcgcgttaccgttgtcgc

SEQ ID NO: 730690 - DNA, 25 bp, Artificial sequence
  Synthetic oligonucleotide
gcgaatcgcgtacgtaacgatcacc

SEQ ID NO: 730691 - DNA, 25 bp, Artificial sequence
  Synthetic oligonucleotide
gcgaatcgcgtaggtaacgatcacc

SEQ ID NO: 730692 - DNA, 25 bp, Artificial sequence
  Synthetic oligonucleotide
acaccgcgcgaattagcgtccatct

SEQ ID NO: 730693 - DNA, 25 bp, Artificial sequence
  Synthetic oligonucleotide
acaccgcgcgaaatagcgtccatct

SEQ ID NO: 730694 - DNA, 25 bp, Artificial sequence
  Synthetic oligonucleotide
tcaggggcgcgtcacgtatagtatc

SEQ ID NO: 730695 - DNA, 25 bp, Artificial sequence
  Synthetic oligonucleotide
gctcatctatgtgtcgcgaacggga

SEQ ID NO: 730696 - DNA, 25 bp, Artificial sequence
  Synthetic oligonucleotide
gcatcaactcggaacgtcgcagaag

SEQ ID NO: 730697 - DNA, 25 bp, Artificial sequence
  Synthetic oligonucleotide
gcacggacccgccagtaatagcttt

SEQ ID NO: 730698 - DNA, 25 bp, Artificial sequence
  Synthetic oligonucleotide
cacgcaaacctaacgccgatggtca

SEQ ID NO: 730699 - DNA, 25 bp, Artificial sequence
  Synthetic oligonucleotide
cggaatcgtcgtaaacgcctagctg

SEQ ID NO: 730700 - DNA, 25 bp, Artificial sequence
  Synthetic oligonucleotide
cggaatcgtcgttaacgcctagctg

SEQ ID NO: 730701 - DNA, 25 bp, Artificial sequence
  Synthetic oligonucleotide
aagcgtgccgggggaattatcgcat

SEQ ID NO: 730702 - DNA, 25 bp, Artificial sequence
  Synthetic oligonucleotide
aagcgtgccgggcgaattatcgcat

SEQ ID NO: 730703 - DNA, 25 bp, Artificial sequence
  Synthetic oligonucleotide
tacatgcacgaacgtctcgacaccg

SEQ ID NO: 730704 - DNA, 25 bp, Artificial sequence
  Synthetic oligonucleotide
tacatgcacgaaggtctcgacaccg

SEQ ID NO: 730705 - DNA, 25 bp, Artificial sequence
  Synthetic oligonucleotide
gcctagaacgtatcgacgcaagacc

SEQ ID NO: 730706 - DNA, 25 bp, Artificial sequence
  Synthetic oligonucleotide
gcctagaacgtaacgacgcaagacc

SEQ ID NO: 730707 - DNA, 25 bp, Artificial sequence
  Synthetic oligonucleotide
caaaggctacgtcgcgcatgattcg

SEQ ID NO: 730708 - DNA, 25 bp, Artificial sequence
  Synthetic oligonucleotide
cgtcacaaacgcccgataggagaga

SEQ ID NO: 730709 - DNA, 25 bp, Artificial sequence
  Synthetic oligonucleotide
gctcatctatgtctcgcgaacggga

SEQ ID NO: 730710 - DNA, 25 bp, Artificial sequence
  Synthetic oligonucleotide
cctatgcctagttcgtcgaccccaa

SEQ ID NO: 730711 - DNA, 25 bp, Artificial sequence
  Synthetic oligonucleotide
tttacgctaacgtccgcgtacggac

SEQ ID NO: 730712 - DNA, 25 bp, Artificial sequence
  Synthetic oligonucleotide
tttacgctaacgaccgcgtacggac

SEQ ID NO: 730713 - DNA, 25 bp, Artificial sequence
  Synthetic oligonucleotide
gttaggagcgccaatcgagtcgtct

SEQ ID NO: 730714 - DNA, 25 bp, Artificial sequence
  Synthetic oligonucleotide
gtgcctaccgtcccataagcatggt

SEQ ID NO: 730715 - DNA, 25 bp, Artificial sequence
  Synthetic oligonucleotide
gtgcctaccgtcgcataagcatggt

SEQ ID NO: 730716 - DNA, 25 bp, Artificial sequence
  Synthetic oligonucleotide
ttcgggtcctagggatacggttgac

SEQ ID NO: 730717 - DNA, 25 bp, Artificial sequence
  Synthetic oligonucleotide
ttcgggtcctagcgatacggttgac

SEQ ID NO: 730718 - DNA, 25 bp, Artificial sequence
  Synthetic oligonucleotide
tgttctcgcgctagtcgtaaccagg

SEQ ID NO: 730719 - DNA, 25 bp, Artificial sequence
  Synthetic oligonucleotide
tgttctcgcgcttgtcgtaaccagg

SEQ ID NO: 730720 - DNA, 25 bp, Artificial sequence
  Synthetic oligonucleotide
ctggcgcgtacggcgactataatct

SEQ ID NO: 730721 - DNA, 25 bp, Artificial sequence
  Synthetic oligonucleotide
ctggcgcgtacgccgactataatct

SEQ ID NO: 730722 - DNA, 25 bp, Artificial sequence
  Synthetic oligonucleotide
gtgcgtatagcggcattcgtgtgga

SEQ ID NO: 730723 - DNA, 25 bp, Artificial sequence
  Synthetic oligonucleotide
caaaggctacgtggcgcatgattcg

SEQ ID NO: 730724 - DNA, 25 bp, Artificial sequence
  Synthetic oligonucleotide
gcttacgttcgccataacgcgttgc

SEQ ID NO: 730725 - DNA, 25 bp, Artificial sequence
  Synthetic oligonucleotide
ggggtcatcgtggggtaagatgatg

SEQ ID NO: 730726 - DNA, 25 bp, Artificial sequence
  Synthetic oligonucleotide
acgccttttggactacgcgcacctt

SEQ ID NO: 730727 - DNA, 25 bp, Artificial sequence
  Synthetic oligonucleotide
acgccttttggagtacgcgcacctt

SEQ ID NO: 730728 - DNA, 25 bp, Artificial sequence
  Synthetic oligonucleotide
cccccgtagcgtggtacgaacatta

SEQ ID NO: 730729 - DNA, 25 bp, Artificial sequence
  Synthetic oligonucleotide
cccccgtagcgtcgtacgaacatta

SEQ ID NO: 730730 - DNA, 25 bp, Artificial sequence
  Synthetic oligonucleotide
gtcacttaccgtcgaacgatggctg

SEQ ID NO: 730731 - DNA, 25 bp, Artificial sequence
  Synthetic oligonucleotide
ggttttcagatacgcgtcggtaggg

SEQ ID NO: 730732 - DNA, 25 bp, Artificial sequence
  Synthetic oligonucleotide
ggttttcagataggcgtcggtaggg

SEQ ID NO: 730733 - DNA, 25 bp, Artificial sequence
  Synthetic oligonucleotide
tacaggctacgcccgaaactcaagc

SEQ ID NO: 730734 - DNA, 25 bp, Artificial sequence
  Synthetic oligonucleotide
tacaggctacgcgcgaaactcaagc

SEQ ID NO: 730735 - DNA, 25 bp, Artificial sequence
  Synthetic oligonucleotide
acagccttagcgatacgggcaagtg

SEQ ID NO: 730736 - DNA, 25 bp, Artificial sequence
  Synthetic oligonucleotide
cgttcgtgcgttaagaccgtgctga

SEQ ID NO: 730737 - DNA, 25 bp, Artificial sequence
  Synthetic oligonucleotide
ggggtcatcgtgcggtaagatgatg

SEQ ID NO: 730738 - DNA, 25 bp, Artificial sequence
  Synthetic oligonucleotide
gcttacgttcgcgataacgcgttgc

SEQ ID NO: 730739 - DNA, 25 bp, Artificial sequence
  Synthetic oligonucleotide
gtcacttaccgtggaacgatggctg

SEQ ID NO: 730740 - DNA, 25 bp, Artificial sequence
  Synthetic oligonucleotide
aacgtgtccgcggtcggtatctcta

SEQ ID NO: 730741 - DNA, 25 bp, Artificial sequence
  Synthetic oligonucleotide
aacgtgtccgcgctcggtatctcta

SEQ ID NO: 730742 - DNA, 25 bp, Artificial sequence
  Synthetic oligonucleotide
tccagttcgtagcgtcgcgttgaca

SEQ ID NO: 730743 - DNA, 25 bp, Artificial sequence
  Synthetic oligonucleotide
tccagttcgtagggtcgcgttgaca

SEQ ID NO: 730744 - DNA, 25 bp, Artificial sequence
  Synthetic oligonucleotide
tgtgctaaaccgtccgcgcatagtc

SEQ ID NO: 730745 - DNA, 25 bp, Artificial sequence
  Synthetic oligonucleotide
tgtgctaaaccgaccgcgcatagtc

SEQ ID NO: 730746 - DNA, 25 bp, Artificial sequence
  Synthetic oligonucleotide
tctaacggtccggcgtaatctaccg

SEQ ID NO: 730747 - DNA, 25 bp, Artificial sequence
  Synthetic oligonucleotide
tctaacggtccgccgtaatctaccg

SEQ ID NO: 730748 - DNA, 25 bp, Artificial sequence
  Synthetic oligonucleotide
ggcagcgattccccgatcactttct

SEQ ID NO: 730749 - DNA, 25 bp, Artificial sequence
  Synthetic oligonucleotide
ggcagcgattccgcgatcactttct

SEQ ID NO: 730750 - DNA, 25 bp, Artificial sequence
  Synthetic oligonucleotide
ccctaggttagctcgcgtacaacgt

SEQ ID NO: 730751 - DNA, 25 bp, Artificial sequence
  Synthetic oligonucleotide
ccctaggttagcacgcgtacaacgt

SEQ ID NO: 730752 - DNA, 25 bp, Artificial sequence
  Synthetic oligonucleotide
catagtcgcgcgtccaaaaaggcga

SEQ ID NO: 730753 - DNA, 25 bp, Artificial sequence
  Synthetic oligonucleotide
catagtcgcgcgaccaaaaaggcga

SEQ ID NO: 730754 - DNA, 25 bp, Artificial sequence
  Synthetic oligonucleotide
gaggggtacgtatgtcgcgaatgtg

SEQ ID NO: 730755 - DNA, 25 bp, Artificial sequence
  Synthetic oligonucleotide
gtgtgatagcgccagctatctggtg

SEQ ID NO: 730756 - DNA, 25 bp, Artificial sequence
  Synthetic oligonucleotide
gcatttatagtgcgtcggtcgcctg

SEQ ID NO: 730757 - DNA, 25 bp, Artificial sequence
  Synthetic oligonucleotide
atgccaagctatcgccggtagtctc

SEQ ID NO: 730758 - DNA, 25 bp, Artificial sequence
  Synthetic oligonucleotide
ccctaataggtaggcgggaagctca

SEQ ID NO: 730759 - DNA, 25 bp, Artificial sequence
  Synthetic oligonucleotide
ccctaataggtacgcgggaagctca

SEQ ID NO: 730760 - DNA, 25 bp, Artificial sequence
  Synthetic oligonucleotide
gaacctccgaacgacctagcgatct

SEQ ID NO: 730761 - DNA, 25 bp, Artificial sequence
  Synthetic oligonucleotide
gaacctccgaaccacctagcgatct

SEQ ID NO: 730762 - DNA, 25 bp, Artificial sequence
  Synthetic oligonucleotide
gtgtgatagcgcgagctatctggtg

SEQ ID NO: 730763 - DNA, 25 bp, Artificial sequence
  Synthetic oligonucleotide
ataatccgggtctcgcgtagggtag

SEQ ID NO: 730764 - DNA, 25 bp, Artificial sequence
  Synthetic oligonucleotide
atgccaagctatggccggtagtctc

SEQ ID NO: 730765 - DNA, 25 bp, Artificial sequence
  Synthetic oligonucleotide
gaggggtacgtaagtcgcgaatgtg

SEQ ID NO: 730766 - DNA, 25 bp, Artificial sequence
  Synthetic oligonucleotide
actcaagcgctaaatgacggccctg

SEQ ID NO: 730767 - DNA, 25 bp, Artificial sequence
  Synthetic oligonucleotide
actcaagcgctatatgacggccctg

SEQ ID NO: 730768 - DNA, 25 bp, Artificial sequence
  Synthetic oligonucleotide
acaagctacgcggacggttacgagt

SEQ ID NO: 730769 - DNA, 25 bp, Artificial sequence
  Synthetic oligonucleotide
acaagctacgcgcacggttacgagt

SEQ ID NO: 730770 - DNA, 25 bp, Artificial sequence
  Synthetic oligonucleotide
gcaggctcggcgtaacactgattca

SEQ ID NO: 730771 - DNA, 25 bp, Artificial sequence
  Synthetic oligonucleotide
gcaggctcggcgaaacactgattca

SEQ ID NO: 730772 - DNA, 25 bp, Artificial sequence
  Synthetic oligonucleotide
ataatccgggtcacgcgtagggtag

SEQ ID NO: 730773 - DNA, 25 bp, Artificial sequence
  Synthetic oligonucleotide
acagatttacgatcgtcccctgggg

SEQ ID NO: 730774 - DNA, 25 bp, Artificial sequence
  Synthetic oligonucleotide
ccattagttcgatagcgcagcaggc

SEQ ID NO: 730775 - DNA, 25 bp, Artificial sequence
  Synthetic oligonucleotide
ccattagttcgaaagcgcagcaggc

SEQ ID NO: 730776 - DNA, 25 bp, Artificial sequence
  Synthetic oligonucleotide
agcggtaattgggctcgcgtcaaag

SEQ ID NO: 730777 - DNA, 25 bp, Artificial sequence
  Synthetic oligonucleotide
gcatttatagtgggtcggtcgcctg

SEQ ID NO: 730778 - DNA, 25 bp, Artificial sequence
  Synthetic oligonucleotide
gaattacgcaaccctagtggctcgc

SEQ ID NO: 730779 - DNA, 25 bp, Artificial sequence
  Synthetic oligonucleotide
agcggtaattggcctcgcgtcaaag

SEQ ID NO: 730780 - DNA, 25 bp, Artificial sequence
  Synthetic oligonucleotide
gaattacgcaacgctagtggctcgc

SEQ ID NO: 730781 - DNA, 25 bp, Artificial sequence
  Synthetic oligonucleotide
acagatttacgaacgtcccctgggg

SEQ ID NO: 730782 - DNA, 25 bp, Artificial sequence
  Synthetic oligonucleotide
tgcgcgcgacgaaacgtcactctga

SEQ ID NO: 730783 - DNA, 25 bp, Artificial sequence
  Synthetic oligonucleotide
tgcgcgcgacgatacgtcactctga

SEQ ID NO: 730784 - DNA, 25 bp, Artificial sequence
  Synthetic oligonucleotide
ggcgtgtacgtaccgctcctaaggt

SEQ ID NO: 730785 - DNA, 25 bp, Artificial sequence
  Synthetic oligonucleotide
cctcttaaactctagcgcgaggggg

SEQ ID NO: 730786 - DNA, 25 bp, Artificial sequence
  Synthetic oligonucleotide
cctcttaaactcaagcgcgaggggg

SEQ ID NO: 730787 - DNA, 25 bp, Artificial sequence
  Synthetic oligonucleotide
actcactagcgacgttcggagctgc

SEQ ID NO: 730788 - DNA, 25 bp, Artificial sequence
  Synthetic oligonucleotide
ggcgtgtacgtagcgctcctaaggt

SEQ ID NO: 730789 - DNA, 25 bp, Artificial sequence
  Synthetic oligonucleotide
agcacggacgcgctcgtatgtacgt

SEQ ID NO: 730790 - DNA, 25 bp, Artificial sequence
  Synthetic oligonucleotide
ctctcctacgtccgctagcggatgt

SEQ ID NO: 730791 - DNA, 25 bp, Artificial sequence
  Synthetic oligonucleotide
atcgggtaatgttccgcgaccgtgc

SEQ ID NO: 730792 - DNA, 25 bp, Artificial sequence
  Synthetic oligonucleotide
actcactagcgaggttcggagctgc

SEQ ID NO: 730793 - DNA, 25 bp, Artificial sequence
  Synthetic oligonucleotide
ggagagacgcgccctaagttgctct

SEQ ID NO: 730794 - DNA, 25 bp, Artificial sequence
  Synthetic oligonucleotide
tgctcttggatcgcggttaagcgcc

SEQ ID NO: 730795 - DNA, 25 bp, Artificial sequence
  Synthetic oligonucleotide
gttcgcacgcgaaatctcgaggacg

SEQ ID NO: 730796 - DNA, 25 bp, Artificial sequence
  Synthetic oligonucleotide
tgctcttggatcccggttaagcgcc

SEQ ID NO: 730797 - DNA, 25 bp, Artificial sequence
  Synthetic oligonucleotide
gttcgcacgcgatatctcgaggacg

SEQ ID NO: 730798 - DNA, 25 bp, Artificial sequence
  Synthetic oligonucleotide
atcgggtaatgtaccgcgaccgtgc

SEQ ID NO: 730799 - DNA, 25 bp, Artificial sequence
  Synthetic oligonucleotide
agcacggacgcggtcgtatgtacgt

SEQ ID NO: 730800 - DNA, 25 bp, Artificial sequence
  Synthetic oligonucleotide
ggagagacgcgcgctaagttgctct

SEQ ID NO: 730801 - DNA, 25 bp, Artificial sequence
  Synthetic oligonucleotide
atcctcacggtaggcgttaggcctc

SEQ ID NO: 730802 - DNA, 25 bp, Artificial sequence
  Synthetic oligonucleotide
gcggaggcgaaccgtataccatgca

SEQ ID NO: 730803 - DNA, 25 bp, Artificial sequence
  Synthetic oligonucleotide
tgggggataggcgcgatcgaagaag

SEQ ID NO: 730804 - DNA, 25 bp, Artificial sequence
  Synthetic oligonucleotide
atgccccgccgaacgtactctagtc

SEQ ID NO: 730805 - DNA, 25 bp, Artificial sequence
  Synthetic oligonucleotide
atgccccgccgatcgtactctagtc

SEQ ID NO: 730806 - DNA, 25 bp, Artificial sequence
  Synthetic oligonucleotide
caaccagcccgttgtacgctatccg

SEQ ID NO: 730807 - DNA, 25 bp, Artificial sequence
  Synthetic oligonucleotide
caaccagcccgtagtacgctatccg

SEQ ID NO: 730808 - DNA, 25 bp, Artificial sequence
  Synthetic oligonucleotide
aggagctcgcgtacctatcggttcg

SEQ ID NO: 730809 - DNA, 25 bp, Artificial sequence
  Synthetic oligonucleotide
aggagctcgcgttcctatcggttcg

SEQ ID NO: 730810 - DNA, 25 bp, Artificial sequence
  Synthetic oligonucleotide
gtgccccgcgataggtagccgtaat

SEQ ID NO: 730811 - DNA, 25 bp, Artificial sequence
  Synthetic oligonucleotide
atcctcacggtacgcgttaggcctc

SEQ ID NO: 730812 - DNA, 25 bp, Artificial sequence
  Synthetic oligonucleotide
ctctcctacgtcggctagcggatgt

SEQ ID NO: 730813 - DNA, 25 bp, Artificial sequence
  Synthetic oligonucleotide
gcttcgtcgtactccgacgctgaac

SEQ ID NO: 730814 - DNA, 25 bp, Artificial sequence
  Synthetic oligonucleotide
gccatccgcacggtatacggggttt

SEQ ID NO: 730815 - DNA, 25 bp, Artificial sequence
  Synthetic oligonucleotide
gccatccgcacgctatacggggttt

SEQ ID NO: 730816 - DNA, 25 bp, Artificial sequence
  Synthetic oligonucleotide
ttctagcgttaatcgggccgccacg

SEQ ID NO: 730817 - DNA, 25 bp, Artificial sequence
  Synthetic oligonucleotide
ttctagcgttaaacgggccgccacg

SEQ ID NO: 730818 - DNA, 25 bp, Artificial sequence
  Synthetic oligonucleotide
tgctcataacggttcgccgcgcttg

SEQ ID NO: 730819 - DNA, 25 bp, Artificial sequence
  Synthetic oligonucleotide
tgctcataacggatcgccgcgcttg

SEQ ID NO: 730820 - DNA, 25 bp, Artificial sequence
  Synthetic oligonucleotide
tcctaccatgccacgcgtacggaga

SEQ ID NO: 730821 - DNA, 25 bp, Artificial sequence
  Synthetic oligonucleotide
tcctaccatgcctcgcgtacggaga

SEQ ID NO: 730822 - DNA, 25 bp, Artificial sequence
  Synthetic oligonucleotide
gcttcgtcgtacaccgacgctgaac

SEQ ID NO: 730823 - DNA, 25 bp, Artificial sequence
  Synthetic oligonucleotide
gtgccccgcgattggtagccgtaat

SEQ ID NO: 730824 - DNA, 25 bp, Artificial sequence
  Synthetic oligonucleotide
ccgtccacgcgtaagtcgaactgtc

SEQ ID NO: 730825 - DNA, 25 bp, Artificial sequence
  Synthetic oligonucleotide
cccacgatagctcgcgtaccgtagt

SEQ ID NO: 730826 - DNA, 25 bp, Artificial sequence
  Synthetic oligonucleotide
cccacgatagctggcgtaccgtagt

SEQ ID NO: 730827 - DNA, 25 bp, Artificial sequence
  Synthetic oligonucleotide
cttcgctccgaaggcggtactagtg

SEQ ID NO: 730828 - DNA, 25 bp, Artificial sequence
  Synthetic oligonucleotide
cttcgctccgaacgcggtactagtg

SEQ ID NO: 730829 - DNA, 25 bp, Artificial sequence
  Synthetic oligonucleotide
cggcgtcgtatactgccgcatgttc

SEQ ID NO: 730830 - DNA, 25 bp, Artificial sequence
  Synthetic oligonucleotide
cggcgtcgtatagtgccgcatgttc

SEQ ID NO: 730831 - DNA, 25 bp, Artificial sequence
  Synthetic oligonucleotide
tcgcgcatagcgggtcctacagatc

SEQ ID NO: 730832 - DNA, 25 bp, Artificial sequence
  Synthetic oligonucleotide
tcgcgcatagcgcgtcctacagatc

SEQ ID NO: 730833 - DNA, 25 bp, Artificial sequence
  Synthetic oligonucleotide
tcccgacgaggcgacgatagtgaca

SEQ ID NO: 730834 - DNA, 25 bp, Artificial sequence
  Synthetic oligonucleotide
ccgtaccgcgcgtagtatatcgagc

SEQ ID NO: 730835 - DNA, 25 bp, Artificial sequence
  Synthetic oligonucleotide
agccaccggtgtaacgtcgacacga

SEQ ID NO: 730836 - DNA, 25 bp, Artificial sequence
  Synthetic oligonucleotide
ccgtccacgcgttagtcgaactgtc

SEQ ID NO: 730837 - DNA, 25 bp, Artificial sequence
  Synthetic oligonucleotide
gagctgtgagcgggcgtacttttgg

SEQ ID NO: 730838 - DNA, 25 bp, Artificial sequence
  Synthetic oligonucleotide
gagctgtgagcgcgcgtacttttgg

SEQ ID NO: 730839 - DNA, 25 bp, Artificial sequence
  Synthetic oligonucleotide
tgggggataggcccgatcgaagaag

SEQ ID NO: 730840 - DNA, 25 bp, Artificial sequence
  Synthetic oligonucleotide
tcccgacgaggccacgatagtgaca

SEQ ID NO: 730841 - DNA, 25 bp, Artificial sequence
  Synthetic oligonucleotide
cggctagatagcggctcgtcacaga

SEQ ID NO: 730842 - DNA, 25 bp, Artificial sequence
  Synthetic oligonucleotide
aggaacatacgacgcgcacggtagc

SEQ ID NO: 730843 - DNA, 25 bp, Artificial sequence
  Synthetic oligonucleotide
aggaacatacgaggcgcacggtagc

SEQ ID NO: 730844 - DNA, 25 bp, Artificial sequence
  Synthetic oligonucleotide
ccgtaccgcgcgaagtatatcgagc

SEQ ID NO: 730845 - DNA, 25 bp, Artificial sequence
  Synthetic oligonucleotide
gttcaccgcgagacttagctcgacc

SEQ ID NO: 730846 - DNA, 25 bp, Artificial sequence
  Synthetic oligonucleotide
acaagccggtactcgtcgtgcatcg

SEQ ID NO: 730847 - DNA, 25 bp, Artificial sequence
  Synthetic oligonucleotide
acaagccggtacacgtcgtgcatcg

SEQ ID NO: 730848 - DNA, 25 bp, Artificial sequence
  Synthetic oligonucleotide
gaatgccatgtcgcgcctacgccat

SEQ ID NO: 730849 - DNA, 25 bp, Artificial sequence
  Synthetic oligonucleotide
gaatgccatgtcccgcctacgccat

SEQ ID NO: 730850 - DNA, 25 bp, Artificial sequence
  Synthetic oligonucleotide
tacctctaggttggcgagcttcggg

SEQ ID NO: 730851 - DNA, 25 bp, Artificial sequence
  Synthetic oligonucleotide
tacctctaggttcgcgagcttcggg

SEQ ID NO: 730852 - DNA, 25 bp, Artificial sequence
  Synthetic oligonucleotide
tcgcgacgctgcccgattaaggcta

SEQ ID NO: 730853 - DNA, 25 bp, Artificial sequence
  Synthetic oligonucleotide
tcgcgacgctgcgcgattaaggcta

SEQ ID NO: 730854 - DNA, 25 bp, Artificial sequence
  Synthetic oligonucleotide
tgcacccgaccatcccgatctccat

SEQ ID NO: 730855 - DNA, 25 bp, Artificial sequence
  Synthetic oligonucleotide
gcgactaacgcgcctaggcttagag

SEQ ID NO: 730856 - DNA, 25 bp, Artificial sequence
  Synthetic oligonucleotide
tgcacccgaccaacccgatctccat

SEQ ID NO: 730857 - DNA, 25 bp, Artificial sequence
  Synthetic oligonucleotide
gttcaccgcgagtcttagctcgacc

SEQ ID NO: 730858 - DNA, 25 bp, Artificial sequence
  Synthetic oligonucleotide
gcgtcctggggtacgtcgacattca

SEQ ID NO: 730859 - DNA, 25 bp, Artificial sequence
  Synthetic oligonucleotide
gcgtcctggggttcgtcgacattca

SEQ ID NO: 730860 - DNA, 25 bp, Artificial sequence
  Synthetic oligonucleotide
gtgctccgcaccgattagtaagcgc

SEQ ID NO: 730861 - DNA, 25 bp, Artificial sequence
  Synthetic oligonucleotide
gtgctccgcacccattagtaagcgc

SEQ ID NO: 730862 - DNA, 25 bp, Artificial sequence
  Synthetic oligonucleotide
ccatggcgatacccgaccgatccaa

SEQ ID NO: 730863 - DNA, 25 bp, Artificial sequence
  Synthetic oligonucleotide
ccatggcgatacgcgaccgatccaa

SEQ ID NO: 730864 - DNA, 25 bp, Artificial sequence
  Synthetic oligonucleotide
agccaccggtgttacgtcgacacga

SEQ ID NO: 730865 - DNA, 25 bp, Artificial sequence
  Synthetic oligonucleotide
gcggaggcgaacggtataccatgca

SEQ ID NO: 730866 - DNA, 25 bp, Artificial sequence
  Synthetic oligonucleotide
gcgactaacgcggctaggcttagag

SEQ ID NO: 730867 - DNA, 25 bp, Artificial sequence
  Synthetic oligonucleotide
ctgatgccgaccccgtaaaaaggcc

SEQ ID NO: 730868 - DNA, 25 bp, Artificial sequence
  Synthetic oligonucleotide
gaaggagtcgcgggcgtattcgtca

SEQ ID NO: 730869 - DNA, 25 bp, Artificial sequence
  Synthetic oligonucleotide
ctcacgcgtacgggcgattatgggt

SEQ ID NO: 730870 - DNA, 25 bp, Artificial sequence
  Synthetic oligonucleotide
ctcacgcgtacgcgcgattatgggt

SEQ ID NO: 730871 - DNA, 25 bp, Artificial sequence
  Synthetic oligonucleotide
ctgccgcgtatcctacgggctcatt

SEQ ID NO: 730872 - DNA, 25 bp, Artificial sequence
  Synthetic oligonucleotide
ctgccgcgtatcgtacgggctcatt

SEQ ID NO: 730873 - DNA, 25 bp, Artificial sequence
  Synthetic oligonucleotide
cccttacggaccacgatactggctc

SEQ ID NO: 730874 - DNA, 25 bp, Artificial sequence
  Synthetic oligonucleotide
cccttacggacctcgatactggctc

SEQ ID NO: 730875 - DNA, 25 bp, Artificial sequence
  Synthetic oligonucleotide
cgccgcgtatcgtacggagatctga

SEQ ID NO: 730876 - DNA, 25 bp, Artificial sequence
  Synthetic oligonucleotide
cgccgcgtatcgaacggagatctga

SEQ ID NO: 730877 - DNA, 25 bp, Artificial sequence
  Synthetic oligonucleotide
gcgttaccatacccgccgaagctga

SEQ ID NO: 730878 - DNA, 25 bp, Artificial sequence
  Synthetic oligonucleotide
acgctgtaccgtacgcgcacaaagg

SEQ ID NO: 730879 - DNA, 25 bp, Artificial sequence
  Synthetic oligonucleotide
ctgatgccgaccgcgtaaaaaggcc

SEQ ID NO: 730880 - DNA, 25 bp, Artificial sequence
  Synthetic oligonucleotide
ccacgttaacgttgggcgagacagg

SEQ ID NO: 730881 - DNA, 25 bp, Artificial sequence
  Synthetic oligonucleotide
cccaccgatcgaggttcgctaaagc

SEQ ID NO: 730882 - DNA, 25 bp, Artificial sequence
  Synthetic oligonucleotide
cccaccgatcgacgttcgctaaagc

SEQ ID NO: 730883 - DNA, 25 bp, Artificial sequence
  Synthetic oligonucleotide
caacaaacggtattacggcgcgcgg

SEQ ID NO: 730884 - DNA, 25 bp, Artificial sequence
  Synthetic oligonucleotide
caacaaacggtaatacggcgcgcgg

SEQ ID NO: 730885 - DNA, 25 bp, Artificial sequence
  Synthetic oligonucleotide
gagatgccgtacccgatacatggcc

SEQ ID NO: 730886 - DNA, 25 bp, Artificial sequence
  Synthetic oligonucleotide
gagatgccgtacgcgatacatggcc

SEQ ID NO: 730887 - DNA, 25 bp, Artificial sequence
  Synthetic oligonucleotide
gcaatgctagtcccgcgtaggggta

SEQ ID NO: 730888 - DNA, 25 bp, Artificial sequence
  Synthetic oligonucleotide
gcaatgctagtcgcgcgtaggggta

SEQ ID NO: 730889 - DNA, 25 bp, Artificial sequence
  Synthetic oligonucleotide
tgcggggcgcgaggtgtatatgtct

SEQ ID NO: 730890 - DNA, 25 bp, Artificial sequence
  Synthetic oligonucleotide
tgcggggcgcgacgtgtatatgtct

SEQ ID NO: 730891 - DNA, 25 bp, Artificial sequence
  Synthetic oligonucleotide
gcgttaccatacgcgccgaagctga

SEQ ID NO: 730892 - DNA, 25 bp, Artificial sequence
  Synthetic oligonucleotide
cgggcaacttatacccgcgtgtcac

SEQ ID NO: 730893 - DNA, 25 bp, Artificial sequence
  Synthetic oligonucleotide
cgctctacgcgccggtataaaaggg

SEQ ID NO: 730894 - DNA, 25 bp, Artificial sequence
  Synthetic oligonucleotide
agagttgccgtaccgtgatcggagc

SEQ ID NO: 730895 - DNA, 25 bp, Artificial sequence
  Synthetic oligonucleotide
tacccttaacggatcgccgcgatgc

SEQ ID NO: 730896 - DNA, 25 bp, Artificial sequence
  Synthetic oligonucleotide
tacccttaacggttcgccgcgatgc

SEQ ID NO: 730897 - DNA, 25 bp, Artificial sequence
  Synthetic oligonucleotide
cgcctttagactctccgcggtaacc

SEQ ID NO: 730898 - DNA, 25 bp, Artificial sequence
  Synthetic oligonucleotide
cgcctttagactgtccgcggtaacc

SEQ ID NO: 730899 - DNA, 25 bp, Artificial sequence
  Synthetic oligonucleotide
cgacagtataccgcgggcgcttttc

SEQ ID NO: 730900 - DNA, 25 bp, Artificial sequence
  Synthetic oligonucleotide
cgacagtataccccgggcgcttttc

SEQ ID NO: 730901 - DNA, 25 bp, Artificial sequence
  Synthetic oligonucleotide
gtaatcatagcggttcgcgctggcc

SEQ ID NO: 730902 - DNA, 25 bp, Artificial sequence
  Synthetic oligonucleotide
gtaatcatagcgcttcgcgctggcc

SEQ ID NO: 730903 - DNA, 25 bp, Artificial sequence
  Synthetic oligonucleotide
acgctgtaccgttcgcgcacaaagg

SEQ ID NO: 730904 - DNA, 25 bp, Artificial sequence
  Synthetic oligonucleotide
gggtgcgcgtcttgacgactatcag

SEQ ID NO: 730905 - DNA, 25 bp, Artificial sequence
  Synthetic oligonucleotide
cggctagatagccgctcgtcacaga

SEQ ID NO: 730906 - DNA, 25 bp, Artificial sequence
  Synthetic oligonucleotide
cgggcaacttattcccgcgtgtcac

SEQ ID NO: 730907 - DNA, 25 bp, Artificial sequence
  Synthetic oligonucleotide
ccacgtgtacgatcgcgcgctaaca

SEQ ID NO: 730908 - DNA, 25 bp, Artificial sequence
  Synthetic oligonucleotide
ccacgtgtacgaacgcgcgctaaca

SEQ ID NO: 730909 - DNA, 25 bp, Artificial sequence
  Synthetic oligonucleotide
cacacttacgcgcggtatcacgcct

SEQ ID NO: 730910 - DNA, 25 bp, Artificial sequence
  Synthetic oligonucleotide
cacacttacgcggggtatcacgcct

SEQ ID NO: 730911 - DNA, 25 bp, Artificial sequence
  Synthetic oligonucleotide
ctcctaccgtctatacgctggggtc

SEQ ID NO: 730912 - DNA, 25 bp, Artificial sequence
  Synthetic oligonucleotide
ctcctaccgtctttacgctggggtc

SEQ ID NO: 730913 - DNA, 25 bp, Artificial sequence
  Synthetic oligonucleotide
gtgggtggtataaagcgcgcctcca

SEQ ID NO: 730914 - DNA, 25 bp, Artificial sequence
  Synthetic oligonucleotide
gtgggtggtatatagcgcgcctcca

SEQ ID NO: 730915 - DNA, 25 bp, Artificial sequence
  Synthetic oligonucleotide
ccacgttaacgtagggcgagacagg

SEQ ID NO: 730916 - DNA, 25 bp, Artificial sequence
  Synthetic oligonucleotide
gggtgcgcgtctagacgactatcag

SEQ ID NO: 730917 - DNA, 25 bp, Artificial sequence
  Synthetic oligonucleotide
cggcttccgacggtattcggtagca

SEQ ID NO: 730918 - DNA, 25 bp, Artificial sequence
  Synthetic oligonucleotide
gccatctaactcccgcgtagtgacc

SEQ ID NO: 730919 - DNA, 25 bp, Artificial sequence
  Synthetic oligonucleotide
gccatctaactcgcgcgtagtgacc

SEQ ID NO: 730920 - DNA, 25 bp, Artificial sequence
  Synthetic oligonucleotide
cgacacgacgcgtctaggttgacgt

SEQ ID NO: 730921 - DNA, 25 bp, Artificial sequence
  Synthetic oligonucleotide
cgacacgacgcgactaggttgacgt

SEQ ID NO: 730922 - DNA, 25 bp, Artificial sequence
  Synthetic oligonucleotide
gagccggatcgcggaacgtatccta

SEQ ID NO: 730923 - DNA, 25 bp, Artificial sequence
  Synthetic oligonucleotide
gagccggatcgccgaacgtatccta

SEQ ID NO: 730924 - DNA, 25 bp, Artificial sequence
  Synthetic oligonucleotide
acgcttcgactttcgcgagacctgg

SEQ ID NO: 730925 - DNA, 25 bp, Artificial sequence
  Synthetic oligonucleotide
acgcttcgacttacgcgagacctgg

SEQ ID NO: 730926 - DNA, 25 bp, Artificial sequence
  Synthetic oligonucleotide
cgactttcgcgcgtactgaagcgag

SEQ ID NO: 730927 - DNA, 25 bp, Artificial sequence
  Synthetic oligonucleotide
cgactttcgcgcctactgaagcgag

SEQ ID NO: 730928 - DNA, 25 bp, Artificial sequence
  Synthetic oligonucleotide
cccctgagtaaccccggacttctca

SEQ ID NO: 730929 - DNA, 25 bp, Artificial sequence
  Synthetic oligonucleotide
ttgttctacgacctcggacacgggg

SEQ ID NO: 730930 - DNA, 25 bp, Artificial sequence
  Synthetic oligonucleotide
cgctagtacgcgtccgatcttcacg

SEQ ID NO: 730931 - DNA, 25 bp, Artificial sequence
  Synthetic oligonucleotide
cggcttccgacgctattcggtagca

SEQ ID NO: 730932 - DNA, 25 bp, Artificial sequence
  Synthetic oligonucleotide
tggatacgcgctacgatgtacgggc

SEQ ID NO: 730933 - DNA, 25 bp, Artificial sequence
  Synthetic oligonucleotide
tggatacgcgcttcgatgtacgggc

SEQ ID NO: 730934 - DNA, 25 bp, Artificial sequence
  Synthetic oligonucleotide
ttcccaacgatgcgcgtcgacagct

SEQ ID NO: 730935 - DNA, 25 bp, Artificial sequence
  Synthetic oligonucleotide
ttcccaacgatgggcgtcgacagct

SEQ ID NO: 730936 - DNA, 25 bp, Artificial sequence
  Synthetic oligonucleotide
ccggtcagctcgcgcgatataatgc

SEQ ID NO: 730937 - DNA, 25 bp, Artificial sequence
  Synthetic oligonucleotide
ccggtcagctcgggcgatataatgc

SEQ ID NO: 730938 - DNA, 25 bp, Artificial sequence
  Synthetic oligonucleotide
tcgatccgggccctacgtaacttgg

SEQ ID NO: 730939 - DNA, 25 bp, Artificial sequence
  Synthetic oligonucleotide
tcgatccgggccgtacgtaacttgg

SEQ ID NO: 730940 - DNA, 25 bp, Artificial sequence
  Synthetic oligonucleotide
ggagcctatccgggacatatgtcgc

SEQ ID NO: 730941 - DNA, 25 bp, Artificial sequence
  Synthetic oligonucleotide
ttgttctacgacgtcggacacgggg

SEQ ID NO: 730942 - DNA, 25 bp, Artificial sequence
  Synthetic oligonucleotide
agtagccgtcgaacgtaggagcggt

SEQ ID NO: 730943 - DNA, 25 bp, Artificial sequence
  Synthetic oligonucleotide
ggagcctatccgcgacatatgtcgc

SEQ ID NO: 730944 - DNA, 25 bp, Artificial sequence
  Synthetic oligonucleotide
gaaggagtcgcgcgcgtattcgtca

SEQ ID NO: 730945 - DNA, 25 bp, Artificial sequence
  Synthetic oligonucleotide
ctgataacgcgttagcgggaccctc

SEQ ID NO: 730946 - DNA, 25 bp, Artificial sequence
  Synthetic oligonucleotide
ctgataacgcgtaagcgggaccctc

SEQ ID NO: 730947 - DNA, 25 bp, Artificial sequence
  Synthetic oligonucleotide
atgggatcgcgcaagagtggctagc

SEQ ID NO: 730948 - DNA, 25 bp, Artificial sequence
  Synthetic oligonucleotide
atgggatcgcgctagagtggctagc

SEQ ID NO: 730949 - DNA, 25 bp, Artificial sequence
  Synthetic oligonucleotide
gcagcaggtacggcaatacgcctca

SEQ ID NO: 730950 - DNA, 25 bp, Artificial sequence
  Synthetic oligonucleotide
gcagcaggtacgccaatacgcctca

SEQ ID NO: 730951 - DNA, 25 bp, Artificial sequence
  Synthetic oligonucleotide
atcggtccgtcggtagtactggagg

SEQ ID NO: 730952 - DNA, 25 bp, Artificial sequence
  Synthetic oligonucleotide
atcggtccgtcgctagtactggagg

SEQ ID NO: 730953 - DNA, 25 bp, Artificial sequence
  Synthetic oligonucleotide
aagctacggggtgtatcgcggacga

SEQ ID NO: 730954 - DNA, 25 bp, Artificial sequence
  Synthetic oligonucleotide
cctcaacgacgcaagcgtacccaag

SEQ ID NO: 730955 - DNA, 25 bp, Artificial sequence
  Synthetic oligonucleotide
aagctacggggtctatcgcggacga

SEQ ID NO: 730956 - DNA, 25 bp, Artificial sequence
  Synthetic oligonucleotide
agtagccgtcgatcgtaggagcggt

SEQ ID NO: 730957 - DNA, 25 bp, Artificial sequence
  Synthetic oligonucleotide
caggacgggctattacgcgccaaac

SEQ ID NO: 730958 - DNA, 25 bp, Artificial sequence
  Synthetic oligonucleotide
caggacgggctaatacgcgccaaac

SEQ ID NO: 730959 - DNA, 25 bp, Artificial sequence
  Synthetic oligonucleotide
cggaattcgtacgccgtaccgtgac

SEQ ID NO: 730960 - DNA, 25 bp, Artificial sequence
  Synthetic oligonucleotide
cggaattcgtaccccgtaccgtgac

SEQ ID NO: 730961 - DNA, 25 bp, Artificial sequence
  Synthetic oligonucleotide
acacacatatagggggtcgagcgcc

SEQ ID NO: 730962 - DNA, 25 bp, Artificial sequence
  Synthetic oligonucleotide
acacacatatagcgggtcgagcgcc

SEQ ID NO: 730963 - DNA, 25 bp, Artificial sequence
  Synthetic oligonucleotide
ccacagctagcgaaccggactcaca

SEQ ID NO: 730964 - DNA, 25 bp, Artificial sequence
  Synthetic oligonucleotide
ccacagctagcgtaccggactcaca

SEQ ID NO: 730965 - DNA, 25 bp, Artificial sequence
  Synthetic oligonucleotide
cgctagtacgcgaccgatcttcacg

SEQ ID NO: 730966 - DNA, 25 bp, Artificial sequence
  Synthetic oligonucleotide
cccctgagtaacgccggacttctca

SEQ ID NO: 730967 - DNA, 25 bp, Artificial sequence
  Synthetic oligonucleotide
cctcaacgacgctagcgtacccaag

SEQ ID NO: 730968 - DNA, 25 bp, Artificial sequence
  Synthetic oligonucleotide
gggtatcgtaaggcgtagtcgagcc

SEQ ID NO: 730969 - DNA, 25 bp, Artificial sequence
  Synthetic oligonucleotide
ttacggacgcgtggtacctcacggt

SEQ ID NO: 730970 - DNA, 25 bp, Artificial sequence
  Synthetic oligonucleotide
ttacggacgcgtcgtacctcacggt

SEQ ID NO: 730971 - DNA, 25 bp, Artificial sequence
  Synthetic oligonucleotide
cttgccgacgcgttatacggagagc

SEQ ID NO: 730972 - DNA, 25 bp, Artificial sequence
  Synthetic oligonucleotide
cttgccgacgcgatatacggagagc

SEQ ID NO: 730973 - DNA, 25 bp, Artificial sequence
  Synthetic oligonucleotide
agctgccgtacgatcggaggacgta

SEQ ID NO: 730974 - DNA, 25 bp, Artificial sequence
  Synthetic oligonucleotide
agctgccgtacgttcggaggacgta

SEQ ID NO: 730975 - DNA, 25 bp, Artificial sequence
  Synthetic oligonucleotide
gtgcctacccgtacggatatcgtcg

SEQ ID NO: 730976 - DNA, 25 bp, Artificial sequence
  Synthetic oligonucleotide
gtgcctacccgttcggatatcgtcg

SEQ ID NO: 730977 - DNA, 25 bp, Artificial sequence
  Synthetic oligonucleotide
agcaccattgactaccgcgcgccaa

SEQ ID NO: 730978 - DNA, 25 bp, Artificial sequence
  Synthetic oligonucleotide
agcaccattgacaaccgcgcgccaa

SEQ ID NO: 730979 - DNA, 25 bp, Artificial sequence
  Synthetic oligonucleotide
ctcgcatgcgagcttaccgtacctg

SEQ ID NO: 730980 - DNA, 25 bp, Artificial sequence
  Synthetic oligonucleotide
cggtgccgttagacggtaactgcac

SEQ ID NO: 730981 - DNA, 25 bp, Artificial sequence
  Synthetic oligonucleotide
gttaccgtatacccccggatgagcc

SEQ ID NO: 730982 - DNA, 25 bp, Artificial sequence
  Synthetic oligonucleotide
gggtatcgtaagccgtagtcgagcc

SEQ ID NO: 730983 - DNA, 25 bp, Artificial sequence
  Synthetic oligonucleotide
tctccgcgtccgacgagtaaaacgc

SEQ ID NO: 730984 - DNA, 25 bp, Artificial sequence
  Synthetic oligonucleotide
tctccgcgtccgtcgagtaaaacgc

SEQ ID NO: 730985 - DNA, 25 bp, Artificial sequence
  Synthetic oligonucleotide
cacaatcgcgctttcagtcggctgg

SEQ ID NO: 730986 - DNA, 25 bp, Artificial sequence
  Synthetic oligonucleotide
cacaatcgcgctatcagtcggctgg

SEQ ID NO: 730987 - DNA, 25 bp, Artificial sequence
  Synthetic oligonucleotide
tgcgcccgactaaccgcgatgttga

SEQ ID NO: 730988 - DNA, 25 bp, Artificial sequence
  Synthetic oligonucleotide
tgcgcccgactatccgcgatgttga

SEQ ID NO: 730989 - DNA, 25 bp, Artificial sequence
  Synthetic oligonucleotide
ggtctacgccgttacgctggactgt

SEQ ID NO: 730990 - DNA, 25 bp, Artificial sequence
  Synthetic oligonucleotide
ggtctacgccgtaacgctggactgt

SEQ ID NO: 730991 - DNA, 25 bp, Artificial sequence
  Synthetic oligonucleotide
aagggcggtgcttcgtcgtcggata

SEQ ID NO: 730992 - DNA, 25 bp, Artificial sequence
  Synthetic oligonucleotide
aagggcggtgctacgtcgtcggata

SEQ ID NO: 730993 - DNA, 25 bp, Artificial sequence
  Synthetic oligonucleotide
cggtgccgttagtcggtaactgcac

SEQ ID NO: 730994 - DNA, 25 bp, Artificial sequence
  Synthetic oligonucleotide
acgagagtccggttatgcggctcgt

SEQ ID NO: 730995 - DNA, 25 bp, Artificial sequence
  Synthetic oligonucleotide
ctcgcatgcgaggttaccgtacctg

SEQ ID NO: 730996 - DNA, 25 bp, Artificial sequence
  Synthetic oligonucleotide
atcccttgtcccccgatagcccaag

SEQ ID NO: 730997 - DNA, 25 bp, Artificial sequence
  Synthetic oligonucleotide
atcccttgtcccgcgatagcccaag

SEQ ID NO: 730998 - DNA, 25 bp, Artificial sequence
  Synthetic oligonucleotide
acgtgctcacgtgcgctagacacac

SEQ ID NO: 730999 - DNA, 25 bp, Artificial sequence
  Synthetic oligonucleotide
acgtgctcacgtccgctagacacac

SEQ ID NO: 731000 - DNA, 25 bp, Artificial sequence
  Synthetic oligonucleotide
cgcggtaagtcgccttacgcagatg

SEQ ID NO: 731001 - DNA, 25 bp, Artificial sequence
  Synthetic oligonucleotide
cgcggtaagtcggcttacgcagatg

SEQ ID NO: 731002 - DNA, 25 bp, Artificial sequence
  Synthetic oligonucleotide
tgggagcgtgagggacgatgtacct

SEQ ID NO: 731003 - DNA, 25 bp, Artificial sequence
  Synthetic oligonucleotide
tgggagcgtgagcgacgatgtacct

SEQ ID NO: 731004 - DNA, 25 bp, Artificial sequence
  Synthetic oligonucleotide
ctgctcataccgagtcgcgtacgca

SEQ ID NO: 731005 - DNA, 25 bp, Artificial sequence
  Synthetic oligonucleotide
ctgctcataccgtgtcgcgtacgca

SEQ ID NO: 731006 - DNA, 25 bp, Artificial sequence
  Synthetic oligonucleotide
agtcggcggccccttacgtgataga

SEQ ID NO: 731007 - DNA, 25 bp, Artificial sequence
  Synthetic oligonucleotide
acccgaccgacgcgtgatcgatatg

SEQ ID NO: 731008 - DNA, 25 bp, Artificial sequence
  Synthetic oligonucleotide
agtcggcggcccgttacgtgataga

SEQ ID NO: 731009 - DNA, 25 bp, Artificial sequence
  Synthetic oligonucleotide
acgagagtccggatatgcggctcgt

SEQ ID NO: 731010 - DNA, 25 bp, Artificial sequence
  Synthetic oligonucleotide
atacgattgcgccttgtagggcggc

SEQ ID NO: 731011 - DNA, 25 bp, Artificial sequence
  Synthetic oligonucleotide
atacgattgcgcgttgtagggcggc

SEQ ID NO: 731012 - DNA, 25 bp, Artificial sequence
  Synthetic oligonucleotide
aggatgtcgtgcgttagcgagctgc

SEQ ID NO: 731013 - DNA, 25 bp, Artificial sequence
  Synthetic oligonucleotide
aggatgtcgtgccttagcgagctgc

SEQ ID NO: 731014 - DNA, 25 bp, Artificial sequence
  Synthetic oligonucleotide
ggttgggcggtaaatcgagagcacc

SEQ ID NO: 731015 - DNA, 25 bp, Artificial sequence
  Synthetic oligonucleotide
ggttgggcggtatatcgagagcacc

SEQ ID NO: 731016 - DNA, 25 bp, Artificial sequence
  Synthetic oligonucleotide
atcgcgctcgcatcgtgcgacaatg

SEQ ID NO: 731017 - DNA, 25 bp, Artificial sequence
  Synthetic oligonucleotide
atcgcgctcgcaacgtgcgacaatg

SEQ ID NO: 731018 - DNA, 25 bp, Artificial sequence
  Synthetic oligonucleotide
gttaccgtatacgcccggatgagcc

SEQ ID NO: 731019 - DNA, 25 bp, Artificial sequence
  Synthetic oligonucleotide
gcggagtaacgtgtcgcggaaatcg

SEQ ID NO: 731020 - DNA, 25 bp, Artificial sequence
  Synthetic oligonucleotide
acccgaccgacgggtgatcgatatg

SEQ ID NO: 731021 - DNA, 25 bp, Artificial sequence
  Synthetic oligonucleotide
gtagtcgacgttacgtcgccagagc

SEQ ID NO: 731022 - DNA, 25 bp, Artificial sequence
  Synthetic oligonucleotide
ctggtgtactacgggtcggatgtgc

SEQ ID NO: 731023 - DNA, 25 bp, Artificial sequence
  Synthetic oligonucleotide
tggagttaacgtaccgcgggacgga

SEQ ID NO: 731024 - DNA, 25 bp, Artificial sequence
  Synthetic oligonucleotide
tggagttaacgttccgcgggacgga

SEQ ID NO: 731025 - DNA, 25 bp, Artificial sequence
  Synthetic oligonucleotide
cgccgtggcgcatcctagtaaaagc

SEQ ID NO: 731026 - DNA, 25 bp, Artificial sequence
  Synthetic oligonucleotide
cgccgtggcgcaacctagtaaaagc

SEQ ID NO: 731027 - DNA, 25 bp, Artificial sequence
  Synthetic oligonucleotide
tgacggctacgacccgcgtccaaaa

SEQ ID NO: 731028 - DNA, 25 bp, Artificial sequence
  Synthetic oligonucleotide
tgacggctacgagccgcgtccaaaa

SEQ ID NO: 731029 - DNA, 25 bp, Artificial sequence
  Synthetic oligonucleotide
cgaacctgcggcgtgtcgttttggt

SEQ ID NO: 731030 - DNA, 25 bp, Artificial sequence
  Synthetic oligonucleotide
cgaacctgcggcctgtcgttttggt

SEQ ID NO: 731031 - DNA, 25 bp, Artificial sequence
  Synthetic oligonucleotide
tgaggccggacttatgcggagttcg

SEQ ID NO: 731032 - DNA, 25 bp, Artificial sequence
  Synthetic oligonucleotide
tgaggccggactaatgcggagttcg

SEQ ID NO: 731033 - DNA, 25 bp, Artificial sequence
  Synthetic oligonucleotide
cctgtgcgatcgcgttaggtatcgg

SEQ ID NO: 731034 - DNA, 25 bp, Artificial sequence
  Synthetic oligonucleotide
actgaacgggcgacgtgtactgcgt

SEQ ID NO: 731035 - DNA, 25 bp, Artificial sequence
  Synthetic oligonucleotide
acagtgccgagacgttacgacggct

SEQ ID NO: 731036 - DNA, 25 bp, Artificial sequence
  Synthetic oligonucleotide
gtagtcgacgtttcgtcgccagagc

SEQ ID NO: 731037 - DNA, 25 bp, Artificial sequence
  Synthetic oligonucleotide
ggtactgcgaatcgttcccgcttcc

SEQ ID NO: 731038 - DNA, 25 bp, Artificial sequence
  Synthetic oligonucleotide
ggtactgcgaatggttcccgcttcc

SEQ ID NO: 731039 - DNA, 25 bp, Artificial sequence
  Synthetic oligonucleotide
ctgtgcaacgcgtgatcgctagtcc

SEQ ID NO: 731040 - DNA, 25 bp, Artificial sequence
  Synthetic oligonucleotide
ctgtgcaacgcgagatcgctagtcc

SEQ ID NO: 731041 - DNA, 25 bp, Artificial sequence
  Synthetic oligonucleotide
cggaataacgcgggcattacggtcc

SEQ ID NO: 731042 - DNA, 25 bp, Artificial sequence
  Synthetic oligonucleotide
cggaataacgcgcgcattacggtcc

SEQ ID NO: 731043 - DNA, 25 bp, Artificial sequence
  Synthetic oligonucleotide
gccatgatctagctgcgcggtatgc

SEQ ID NO: 731044 - DNA, 25 bp, Artificial sequence
  Synthetic oligonucleotide
gccatgatctaggtgcgcggtatgc

SEQ ID NO: 731045 - DNA, 25 bp, Artificial sequence
  Synthetic oligonucleotide
tgtgctgcgctatgtcggaagaggc

SEQ ID NO: 731046 - DNA, 25 bp, Artificial sequence
  Synthetic oligonucleotide
tgtgctgcgctaagtcggaagaggc

SEQ ID NO: 731047 - DNA, 25 bp, Artificial sequence
  Synthetic oligonucleotide
actgaacgggcgtcgtgtactgcgt

SEQ ID NO: 731048 - DNA, 25 bp, Artificial sequence
  Synthetic oligonucleotide
ttggttgggtagacgtgcgtacccg

SEQ ID NO: 731049 - DNA, 25 bp, Artificial sequence
  Synthetic oligonucleotide
ctggtgtactaccggtcggatgtgc

SEQ ID NO: 731050 - DNA, 25 bp, Artificial sequence
  Synthetic oligonucleotide
gcgtccacccgcgctcttaaaagtg

SEQ ID NO: 731051 - DNA, 25 bp, Artificial sequence
  Synthetic oligonucleotide
gcagcagcggtttcgctagggctaa

SEQ ID NO: 731052 - DNA, 25 bp, Artificial sequence
  Synthetic oligonucleotide
gcagcagcggttacgctagggctaa

SEQ ID NO: 731053 - DNA, 25 bp, Artificial sequence
  Synthetic oligonucleotide
aacgcgttacgcaacgacggtcagc

SEQ ID NO: 731054 - DNA, 25 bp, Artificial sequence
  Synthetic oligonucleotide
aacgcgttacgctacgacggtcagc

SEQ ID NO: 731055 - DNA, 25 bp, Artificial sequence
  Synthetic oligonucleotide
acactggcgcgtggactacgcatct

SEQ ID NO: 731056 - DNA, 25 bp, Artificial sequence
  Synthetic oligonucleotide
acactggcgcgtcgactacgcatct

SEQ ID NO: 731057 - DNA, 25 bp, Artificial sequence
  Synthetic oligonucleotide
tctacccccgtttagcgaggctctg

SEQ ID NO: 731058 - DNA, 25 bp, Artificial sequence
  Synthetic oligonucleotide
tctacccccgttaagcgaggctctg

SEQ ID NO: 731059 - DNA, 25 bp, Artificial sequence
  Synthetic oligonucleotide
gcatcaggtgcgacggttaagaccg

SEQ ID NO: 731060 - DNA, 25 bp, Artificial sequence
  Synthetic oligonucleotide
cctgtgcgatcgggttaggtatcgg

SEQ ID NO: 731061 - DNA, 25 bp, Artificial sequence
  Synthetic oligonucleotide
ttggttgggtagtcgtgcgtacccg

SEQ ID NO: 731062 - DNA, 25 bp, Artificial sequence
  Synthetic oligonucleotide
agagttgccgtagcgtgatcggagc

SEQ ID NO: 731063 - DNA, 25 bp, Artificial sequence
  Synthetic oligonucleotide
ccgcccttaggccaaacgcttcgaa

SEQ ID NO: 731064 - DNA, 25 bp, Artificial sequence
  Synthetic oligonucleotide
ccgcccttaggcgaaacgcttcgaa

SEQ ID NO: 731065 - DNA, 25 bp, Artificial sequence
  Synthetic oligonucleotide
cgaagatagtcgccccgaaccttgc

SEQ ID NO: 731066 - DNA, 25 bp, Artificial sequence
  Synthetic oligonucleotide
cgaagatagtcggcccgaaccttgc

SEQ ID NO: 731067 - DNA, 25 bp, Artificial sequence
  Synthetic oligonucleotide
gtcagagcgagaatacgcggtaggc

SEQ ID NO: 731068 - DNA, 25 bp, Artificial sequence
  Synthetic oligonucleotide
gtcagagcgagattacgcggtaggc

SEQ ID NO: 731069 - DNA, 25 bp, Artificial sequence
  Synthetic oligonucleotide
tttctgttcgcgacgactcgcctcg

SEQ ID NO: 731070 - DNA, 25 bp, Artificial sequence
  Synthetic oligonucleotide
tttctgttcgcgtcgactcgcctcg

SEQ ID NO: 731071 - DNA, 25 bp, Artificial sequence
  Synthetic oligonucleotide
ttgacgtacgtccgagcgcatcgct

SEQ ID NO: 731072 - DNA, 25 bp, Artificial sequence
  Synthetic oligonucleotide
ttgacgtacgtcggagcgcatcgct

SEQ ID NO: 731073 - DNA, 25 bp, Artificial sequence
  Synthetic oligonucleotide
acagtgccgagaggttacgacggct

SEQ ID NO: 731074 - DNA, 25 bp, Artificial sequence
  Synthetic oligonucleotide
gcatcaggtgcgtcggttaagaccg

SEQ ID NO: 731075 - DNA, 25 bp, Artificial sequence
  Synthetic oligonucleotide
tccgtttcgccgctctacgcaggtt

SEQ ID NO: 731076 - DNA, 25 bp, Artificial sequence
  Synthetic oligonucleotide
agccgggcctagcgcgtatttcgat

SEQ ID NO: 731077 - DNA, 25 bp, Artificial sequence
  Synthetic oligonucleotide
cataaccgaccggaagcgtagcgac

SEQ ID NO: 731078 - DNA, 25 bp, Artificial sequence
  Synthetic oligonucleotide
cataaccgaccgcaagcgtagcgac

SEQ ID NO: 731079 - DNA, 25 bp, Artificial sequence
  Synthetic oligonucleotide
gcccattccgaaggcgtactgagct

SEQ ID NO: 731080 - DNA, 25 bp, Artificial sequence
  Synthetic oligonucleotide
gcccattccgaacgcgtactgagct

SEQ ID NO: 731081 - DNA, 25 bp, Artificial sequence
  Synthetic oligonucleotide
gcctttctaacgtctcgcgtcaggg

SEQ ID NO: 731082 - DNA, 25 bp, Artificial sequence
  Synthetic oligonucleotide
gcctttctaacgactcgcgtcaggg

SEQ ID NO: 731083 - DNA, 25 bp, Artificial sequence
  Synthetic oligonucleotide
ggtcttcggtaacgtcgcacgcgta

SEQ ID NO: 731084 - DNA, 25 bp, Artificial sequence
  Synthetic oligonucleotide
ggtcttcggtaaggtcgcacgcgta

SEQ ID NO: 731085 - DNA, 25 bp, Artificial sequence
  Synthetic oligonucleotide
tccccatgcgtaccggctattgcac

SEQ ID NO: 731086 - DNA, 25 bp, Artificial sequence
  Synthetic oligonucleotide
acggcttgcgcgaacgagcttaagc

SEQ ID NO: 731087 - DNA, 25 bp, Artificial sequence
  Synthetic oligonucleotide
tccgtttcgccggtctacgcaggtt

SEQ ID NO: 731088 - DNA, 25 bp, Artificial sequence
  Synthetic oligonucleotide
taagccgccggttcgctagcttgct

SEQ ID NO: 731089 - DNA, 25 bp, Artificial sequence
  Synthetic oligonucleotide
tccccttaagccgttgcggggcata

SEQ ID NO: 731090 - DNA, 25 bp, Artificial sequence
  Synthetic oligonucleotide
tccccttaagcccttgcggggcata

SEQ ID NO: 731091 - DNA, 25 bp, Artificial sequence
  Synthetic oligonucleotide
ggttttgcgtgttacgcgaccgcag

SEQ ID NO: 731092 - DNA, 25 bp, Artificial sequence
  Synthetic oligonucleotide
ggttttgcgtgtaacgcgaccgcag

SEQ ID NO: 731093 - DNA, 25 bp, Artificial sequence
  Synthetic oligonucleotide
gcgtccacccgccctcttaaaagtg

SEQ ID NO: 731094 - DNA, 25 bp, Artificial sequence
  Synthetic oligonucleotide
cgctctacgcgcgggtataaaaggg

SEQ ID NO: 731095 - DNA, 25 bp, Artificial sequence
  Synthetic oligonucleotide
cgcttacggccgttatacgggccaa

SEQ ID NO: 731096 - DNA, 25 bp, Artificial sequence
  Synthetic oligonucleotide
cgcttacggccgatatacgggccaa

SEQ ID NO: 731097 - DNA, 25 bp, Artificial sequence
  Synthetic oligonucleotide
acaggagccgtactacgtcgcttgg

SEQ ID NO: 731098 - DNA, 25 bp, Artificial sequence
  Synthetic oligonucleotide
acaggagccgtagtacgtcgcttgg

SEQ ID NO: 731099 - DNA, 25 bp, Artificial sequence
  Synthetic oligonucleotide
acggcttgcgcgtacgagcttaagc

SEQ ID NO: 731100 - DNA, 25 bp, Artificial sequence
  Synthetic oligonucleotide
tccccatgcgtagcggctattgcac

SEQ ID NO: 731101 - DNA, 25 bp, Artificial sequence
  Synthetic oligonucleotide
agcagtcgaacggctaccggtttgg

SEQ ID NO: 731102 - DNA, 25 bp, Artificial sequence
  Synthetic oligonucleotide
gcggagtaacgtctcgcggaaatcg

SEQ ID NO: 731103 - DNA, 25 bp, Artificial sequence
  Synthetic oligonucleotide
cccctattacgcccgacgtggtctt

SEQ ID NO: 731104 - DNA, 25 bp, Artificial sequence
  Synthetic oligonucleotide
ctttggacgcgcgcgataggcaatg

SEQ ID NO: 731105 - DNA, 25 bp, Artificial sequence
  Synthetic oligonucleotide
ctttggacgcgcccgataggcaatg

SEQ ID NO: 731106 - DNA, 25 bp, Artificial sequence
  Synthetic oligonucleotide
ttcccgcctattggcgactccctag

SEQ ID NO: 731107 - DNA, 25 bp, Artificial sequence
  Synthetic oligonucleotide
ttcccgcctattcgcgactccctag

SEQ ID NO: 731108 - DNA, 25 bp, Artificial sequence
  Synthetic oligonucleotide
gaccgataacgtggcgttcccacgt

SEQ ID NO: 731109 - DNA, 25 bp, Artificial sequence
  Synthetic oligonucleotide
gaccgataacgtcgcgttcccacgt

SEQ ID NO: 731110 - DNA, 25 bp, Artificial sequence
  Synthetic oligonucleotide
ccgttaaatcgtgcgaccgggctct

SEQ ID NO: 731111 - DNA, 25 bp, Artificial sequence
  Synthetic oligonucleotide
ccgttaaatcgtccgaccgggctct

SEQ ID NO: 731112 - DNA, 25 bp, Artificial sequence
  Synthetic oligonucleotide
taaccgcgcgcaattacctccaccg

SEQ ID NO: 731113 - DNA, 25 bp, Artificial sequence
  Synthetic oligonucleotide
cagtcttacgcgacgtgattggccg

SEQ ID NO: 731114 - DNA, 25 bp, Artificial sequence
  Synthetic oligonucleotide
agcagtcgaacgcctaccggtttgg

SEQ ID NO: 731115 - DNA, 25 bp, Artificial sequence
  Synthetic oligonucleotide
taagccgccggtacgctagcttgct

SEQ ID NO: 731116 - DNA, 25 bp, Artificial sequence
  Synthetic oligonucleotide
atgctctggcgacctcgtaagcgct

SEQ ID NO: 731117 - DNA, 25 bp, Artificial sequence
  Synthetic oligonucleotide
atgctctggcgagctcgtaagcgct

SEQ ID NO: 731118 - DNA, 25 bp, Artificial sequence
  Synthetic oligonucleotide
tggacgaccgtacgggagtgcattg

SEQ ID NO: 731119 - DNA, 25 bp, Artificial sequence
  Synthetic oligonucleotide
tggacgaccgtaggggagtgcattg

SEQ ID NO: 731120 - DNA, 25 bp, Artificial sequence
  Synthetic oligonucleotide
ggttatgcgctatcggtatgcggcc

SEQ ID NO: 731121 - DNA, 25 bp, Artificial sequence
  Synthetic oligonucleotide
ggttatgcgctaacggtatgcggcc

SEQ ID NO: 731122 - DNA, 25 bp, Artificial sequence
  Synthetic oligonucleotide
ccagctatcgcgggaagagcttcgt

SEQ ID NO: 731123 - DNA, 25 bp, Artificial sequence
  Synthetic oligonucleotide
ccagctatcgcgcgaagagcttcgt

SEQ ID NO: 731124 - DNA, 25 bp, Artificial sequence
  Synthetic oligonucleotide
cagctgggtctaggcgtagaagacc

SEQ ID NO: 731125 - DNA, 25 bp, Artificial sequence
  Synthetic oligonucleotide
cagctgggtctacgcgtagaagacc

SEQ ID NO: 731126 - DNA, 25 bp, Artificial sequence
  Synthetic oligonucleotide
agccgggcctagggcgtatttcgat

SEQ ID NO: 731127 - DNA, 25 bp, Artificial sequence
  Synthetic oligonucleotide
taaccgcgcgcatttacctccaccg

SEQ ID NO: 731128 - DNA, 25 bp, Artificial sequence
  Synthetic oligonucleotide
cacaccgatctacggcccgattgca

SEQ ID NO: 731129 - DNA, 25 bp, Artificial sequence
  Synthetic oligonucleotide
cgcagcccgatactcgatcacacac

SEQ ID NO: 731130 - DNA, 25 bp, Artificial sequence
  Synthetic oligonucleotide
cgcagcccgatagtcgatcacacac

SEQ ID NO: 731131 - DNA, 25 bp, Artificial sequence
  Synthetic oligonucleotide
ggaagtcgtgcacgacgtactcgct

SEQ ID NO: 731132 - DNA, 25 bp, Artificial sequence
  Synthetic oligonucleotide
ggaagtcgtgcaggacgtactcgct

SEQ ID NO: 731133 - DNA, 25 bp, Artificial sequence
  Synthetic oligonucleotide
gctaaccgtctccacccgtgtgatg

SEQ ID NO: 731134 - DNA, 25 bp, Artificial sequence
  Synthetic oligonucleotide
gctaaccgtctcgacccgtgtgatg

SEQ ID NO: 731135 - DNA, 25 bp, Artificial sequence
  Synthetic oligonucleotide
tgatcggccgtacgcaactagggca

SEQ ID NO: 731136 - DNA, 25 bp, Artificial sequence
  Synthetic oligonucleotide
tgatcggccgtaggcaactagggca

SEQ ID NO: 731137 - DNA, 25 bp, Artificial sequence
  Synthetic oligonucleotide
accgaaatcgttaccgcggacgtgc

SEQ ID NO: 731138 - DNA, 25 bp, Artificial sequence
  Synthetic oligonucleotide
accgaaatcgtttccgcggacgtgc

SEQ ID NO: 731139 - DNA, 25 bp, Artificial sequence
  Synthetic oligonucleotide
gacgtacgccgccataagtcgaagg

SEQ ID NO: 731140 - DNA, 25 bp, Artificial sequence
  Synthetic oligonucleotide
gggagtcgcgtcgttgataagcgag

SEQ ID NO: 731141 - DNA, 25 bp, Artificial sequence
  Synthetic oligonucleotide
cacaccgatctagggcccgattgca

SEQ ID NO: 731142 - DNA, 25 bp, Artificial sequence
  Synthetic oligonucleotide
cacggagacgcttcgcatcgcagat

SEQ ID NO: 731143 - DNA, 25 bp, Artificial sequence
  Synthetic oligonucleotide
ggaaggcgataccggaacgtggttc

SEQ ID NO: 731144 - DNA, 25 bp, Artificial sequence
  Synthetic oligonucleotide
ggaaggcgatacgggaacgtggttc

SEQ ID NO: 731145 - DNA, 25 bp, Artificial sequence
  Synthetic oligonucleotide
tagaccgcgctcggcgtattcatgc

SEQ ID NO: 731146 - DNA, 25 bp, Artificial sequence
  Synthetic oligonucleotide
tagaccgcgctccgcgtattcatgc

SEQ ID NO: 731147 - DNA, 25 bp, Artificial sequence
  Synthetic oligonucleotide
ccctacgtacccatcgcgtgcaagt

SEQ ID NO: 731148 - DNA, 25 bp, Artificial sequence
  Synthetic oligonucleotide
ccctacgtacccttcgcgtgcaagt

SEQ ID NO: 731149 - DNA, 25 bp, Artificial sequence
  Synthetic oligonucleotide
actccggtcgcgtcctacttgcctt

SEQ ID NO: 731150 - DNA, 25 bp, Artificial sequence
  Synthetic oligonucleotide
actccggtcgcgacctacttgcctt

SEQ ID NO: 731151 - DNA, 25 bp, Artificial sequence
  Synthetic oligonucleotide
cacggagacgctacgcatcgcagat

SEQ ID NO: 731152 - DNA, 25 bp, Artificial sequence
  Synthetic oligonucleotide
cccggtcgtccgagcctaattagac

SEQ ID NO: 731153 - DNA, 25 bp, Artificial sequence
  Synthetic oligonucleotide
cccctattacgcgcgacgtggtctt

SEQ ID NO: 731154 - DNA, 25 bp, Artificial sequence
  Synthetic oligonucleotide
cagtcttacgcgtcgtgattggccg

SEQ ID NO: 731155 - DNA, 25 bp, Artificial sequence
  Synthetic oligonucleotide
gacgtacgccgcgataagtcgaagg

SEQ ID NO: 731156 - DNA, 25 bp, Artificial sequence
  Synthetic oligonucleotide
tttcccattctacgccgcggacagg

SEQ ID NO: 731157 - DNA, 25 bp, Artificial sequence
  Synthetic oligonucleotide
tttcccattctaggccgcggacagg

SEQ ID NO: 731158 - DNA, 25 bp, Artificial sequence
  Synthetic oligonucleotide
ggtagccgagatccgtatggtgtcc

SEQ ID NO: 731159 - DNA, 25 bp, Artificial sequence
  Synthetic oligonucleotide
ggtagccgagatgcgtatggtgtcc

SEQ ID NO: 731160 - DNA, 25 bp, Artificial sequence
  Synthetic oligonucleotide
atcgaacgggcgctatacgccatcg

SEQ ID NO: 731161 - DNA, 25 bp, Artificial sequence
  Synthetic oligonucleotide
atcgaacgggcggtatacgccatcg

SEQ ID NO: 731162 - DNA, 25 bp, Artificial sequence
  Synthetic oligonucleotide
ccggtcgatacaaaccgcgtcgtgt

SEQ ID NO: 731163 - DNA, 25 bp, Artificial sequence
  Synthetic oligonucleotide
ccggtcgatacataccgcgtcgtgt

SEQ ID NO: 731164 - DNA, 25 bp, Artificial sequence
  Synthetic oligonucleotide
tcagggcgaccttcgcgtttgatgc

SEQ ID NO: 731165 - DNA, 25 bp, Artificial sequence
  Synthetic oligonucleotide
tcagggcgacctacgcgtttgatgc

SEQ ID NO: 731166 - DNA, 25 bp, Artificial sequence
  Synthetic oligonucleotide
cgcccgcgcacgaactacgtattag

SEQ ID NO: 731167 - DNA, 25 bp, Artificial sequence
  Synthetic oligonucleotide
cgcccgcgcacgtactacgtattag

SEQ ID NO: 731168 - DNA, 25 bp, Artificial sequence
  Synthetic oligonucleotide
cgaggtcgttcgcgcgtagcatact

SEQ ID NO: 731169 - DNA, 25 bp, Artificial sequence
  Synthetic oligonucleotide
caccctcgacgggtacctacatagc

SEQ ID NO: 731170 - DNA, 25 bp, Artificial sequence
  Synthetic oligonucleotide
cgaggtcgttcgggcgtagcatact

SEQ ID NO: 731171 - DNA, 25 bp, Artificial sequence
  Synthetic oligonucleotide
cccggtcgtccgtgcctaattagac

SEQ ID NO: 731172 - DNA, 25 bp, Artificial sequence
  Synthetic oligonucleotide
tccagccggggtggtctataaagcg

SEQ ID NO: 731173 - DNA, 25 bp, Artificial sequence
  Synthetic oligonucleotide
gggagtcgcgtccttgataagcgag

SEQ ID NO: 731174 - DNA, 25 bp, Artificial sequence
  Synthetic oligonucleotide
caccctcgacggctacctacatagc

SEQ ID NO: 731175 - DNA, 25 bp, Artificial sequence
  Synthetic oligonucleotide
cgagcgtcgacgtatgaggcagtga

SEQ ID NO: 731176 - DNA, 25 bp, Artificial sequence
  Synthetic oligonucleotide
cgagcgtcgacgaatgaggcagtga

SEQ ID NO: 731177 - DNA, 25 bp, Artificial sequence
  Synthetic oligonucleotide
aagtgccgcggtattgtcgccgcat

SEQ ID NO: 731178 - DNA, 25 bp, Artificial sequence
  Synthetic oligonucleotide
aagtgccgcggttttgtcgccgcat

SEQ ID NO: 731179 - DNA, 25 bp, Artificial sequence
  Synthetic oligonucleotide
gagcggtatcggaacccgatcacct

SEQ ID NO: 731180 - DNA, 25 bp, Artificial sequence
  Synthetic oligonucleotide
gagcggtatcggtacccgatcacct

SEQ ID NO: 731181 - DNA, 25 bp, Artificial sequence
  Synthetic oligonucleotide
tccagccggggtcgtctataaagcg

SEQ ID NO: 731182 - DNA, 25 bp, Artificial sequence
  Synthetic oligonucleotide
cggacccgcgacccctatatcctga

SEQ ID NO: 731183 - DNA, 25 bp, Artificial sequence
  Synthetic oligonucleotide
tggtgggtccgcgtatcgaagcgtg

SEQ ID NO: 731184 - DNA, 25 bp, Artificial sequence
  Synthetic oligonucleotide
ggattcgttccgtctcgcgagtccc

SEQ ID NO: 731185 - DNA, 25 bp, Artificial sequence
  Synthetic oligonucleotide
ggattcgttccgactcgcgagtccc

SEQ ID NO: 731186 - DNA, 25 bp, Artificial sequence
  Synthetic oligonucleotide
aggtcctagcgtacggcgacccaca

SEQ ID NO: 731187 - DNA, 25 bp, Artificial sequence
  Synthetic oligonucleotide
aggtcctagcgttcggcgacccaca

SEQ ID NO: 731188 - DNA, 25 bp, Artificial sequence
  Synthetic oligonucleotide
ggcttggtatgccgcgtcaggagca

SEQ ID NO: 731189 - DNA, 25 bp, Artificial sequence
  Synthetic oligonucleotide
ggcttggtatgcggcgtcaggagca

SEQ ID NO: 731190 - DNA, 25 bp, Artificial sequence
  Synthetic oligonucleotide
tggtgggtccgcctatcgaagcgtg

SEQ ID NO: 731191 - DNA, 25 bp, Artificial sequence
  Synthetic oligonucleotide
caacctgtacgatccgggaaggggc

SEQ ID NO: 731192 - DNA, 25 bp, Artificial sequence
  Synthetic oligonucleotide
aggaccttaggcgcgacggctactc

SEQ ID NO: 731193 - DNA, 25 bp, Artificial sequence
  Synthetic oligonucleotide
aatcggcgtgcgttcgaccgcacag

SEQ ID NO: 731194 - DNA, 25 bp, Artificial sequence
  Synthetic oligonucleotide
caacctgtacgaaccgggaaggggc

SEQ ID NO: 731195 - DNA, 25 bp, Artificial sequence
  Synthetic oligonucleotide
gcgactgatatcccaggcgcccaac

SEQ ID NO: 731196 - DNA, 25 bp, Artificial sequence
  Synthetic oligonucleotide
gcgactgatatcgcaggcgcccaac

SEQ ID NO: 731197 - DNA, 25 bp, Artificial sequence
  Synthetic oligonucleotide
gagggcatcggaggcgaatggttgg

SEQ ID NO: 731198 - DNA, 25 bp, Artificial sequence
  Synthetic oligonucleotide
gagggcatcggacgcgaatggttgg

SEQ ID NO: 731199 - DNA, 25 bp, Artificial sequence
  Synthetic oligonucleotide
agcggtacggcgcgcgttaatgtcg

SEQ ID NO: 731200 - DNA, 25 bp, Artificial sequence
  Synthetic oligonucleotide
aggaccttaggcccgacggctactc

SEQ ID NO: 731201 - DNA, 25 bp, Artificial sequence
  Synthetic oligonucleotide
tacgcgggtcacgggtacggtcttg

SEQ ID NO: 731202 - DNA, 25 bp, Artificial sequence
  Synthetic oligonucleotide
tacgcgggtcaccggtacggtcttg

SEQ ID NO: 731203 - DNA, 25 bp, Artificial sequence
  Synthetic oligonucleotide
aggcgcagcccgcgtaagtatgacg

SEQ ID NO: 731204 - DNA, 25 bp, Artificial sequence
  Synthetic oligonucleotide
aggcgcagcccgggtaagtatgacg

SEQ ID NO: 731205 - DNA, 25 bp, Artificial sequence
  Synthetic oligonucleotide
aatcggcgtgcgatcgaccgcacag

SEQ ID NO: 731206 - DNA, 25 bp, Artificial sequence
  Synthetic oligonucleotide
cctccagctcgttgcgctaacggct

SEQ ID NO: 731207 - DNA, 25 bp, Artificial sequence
  Synthetic oligonucleotide
ttcgcccggtcggtgcgtattctcc

SEQ ID NO: 731208 - DNA, 25 bp, Artificial sequence
  Synthetic oligonucleotide
agcggtacggcgggcgttaatgtcg

SEQ ID NO: 731209 - DNA, 25 bp, Artificial sequence
  Synthetic oligonucleotide
cctccagctcgtagcgctaacggct

SEQ ID NO: 731210 - DNA, 25 bp, Artificial sequence
  Synthetic oligonucleotide
tcggcataagccggccgtaggcaga

SEQ ID NO: 731211 - DNA, 25 bp, Artificial sequence
  Synthetic oligonucleotide
gaacgccgcaaagggctagtccacg

SEQ ID NO: 731212 - DNA, 25 bp, Artificial sequence
  Synthetic oligonucleotide
aatcagcgagtaaccgcgggggcac

SEQ ID NO: 731213 - DNA, 25 bp, Artificial sequence
  Synthetic oligonucleotide
aatcagcgagtatccgcgggggcac

SEQ ID NO: 731214 - DNA, 25 bp, Artificial sequence
  Synthetic oligonucleotide
gtcacagggtcgcgtcgaatgctcg

SEQ ID NO: 731215 - DNA, 25 bp, Artificial sequence
  Synthetic oligonucleotide
gtcacagggtcgggtcgaatgctcg

SEQ ID NO: 731216 - DNA, 25 bp, Artificial sequence
  Synthetic oligonucleotide
atttggccgcgacgtaacccacggc

SEQ ID NO: 731217 - DNA, 25 bp, Artificial sequence
  Synthetic oligonucleotide
atttggccgcgaggtaacccacggc

SEQ ID NO: 731218 - DNA, 25 bp, Artificial sequence
  Synthetic oligonucleotide
gcgtctgcgcaaatcatcgggctcg

SEQ ID NO: 731219 - DNA, 25 bp, Artificial sequence
  Synthetic oligonucleotide
gcgtctgcgcaattcatcgggctcg

SEQ ID NO: 731220 - DNA, 25 bp, Artificial sequence
  Synthetic oligonucleotide
tgaccggtactcgacgtagcccacc

SEQ ID NO: 731221 - DNA, 25 bp, Artificial sequence
  Synthetic oligonucleotide
tcccagggtacgttcgtacgccgag

SEQ ID NO: 731222 - DNA, 25 bp, Artificial sequence
  Synthetic oligonucleotide
ttcgcccggtcgctgcgtattctcc

SEQ ID NO: 731223 - DNA, 25 bp, Artificial sequence
  Synthetic oligonucleotide
gtagggcggcggttaccgtggtatg

SEQ ID NO: 731224 - DNA, 25 bp, Artificial sequence
  Synthetic oligonucleotide
gaacgccgcaaacggctagtccacg

SEQ ID NO: 731225 - DNA, 25 bp, Artificial sequence
  Synthetic oligonucleotide
tcccagggtacgatcgtacgccgag

SEQ ID NO: 731226 - DNA, 25 bp, Artificial sequence
  Synthetic oligonucleotide
cgtaactaccgaggaacgcgggctc

SEQ ID NO: 731227 - DNA, 25 bp, Artificial sequence
  Synthetic oligonucleotide
cgtaactaccgacgaacgcgggctc

SEQ ID NO: 731228 - DNA, 25 bp, Artificial sequence
  Synthetic oligonucleotide
gcgcggtctgatacgtcgcgaactc

SEQ ID NO: 731229 - DNA, 25 bp, Artificial sequence
  Synthetic oligonucleotide
gcgcggtctgattcgtcgcgaactc

SEQ ID NO: 731230 - DNA, 25 bp, Artificial sequence
  Synthetic oligonucleotide
accgaccggtatctcgcgtgtcgga

SEQ ID NO: 731231 - DNA, 25 bp, Artificial sequence
  Synthetic oligonucleotide
accgaccggtatgtcgcgtgtcgga

SEQ ID NO: 731232 - DNA, 25 bp, Artificial sequence
  Synthetic oligonucleotide
atgtctgacctatccgcgccggcca

SEQ ID NO: 731233 - DNA, 25 bp, Artificial sequence
  Synthetic oligonucleotide
atgtctgacctaaccgcgccggcca

SEQ ID NO: 731234 - DNA, 25 bp, Artificial sequence
  Synthetic oligonucleotide
gtagggcggcggataccgtggtatg

SEQ ID NO: 731235 - DNA, 25 bp, Artificial sequence
  Synthetic oligonucleotide
tgaccggtactccacgtagcccacc

SEQ ID NO: 731236 - DNA, 25 bp, Artificial sequence
  Synthetic oligonucleotide
tcaggcacgtcccgacgtattgccg

SEQ ID NO: 731237 - DNA, 25 bp, Artificial sequence
  Synthetic oligonucleotide
ttgcggcgcttagcggtaggacgct

SEQ ID NO: 731238 - DNA, 25 bp, Artificial sequence
  Synthetic oligonucleotide
cccggtaggtatcgcgaacctgacc

SEQ ID NO: 731239 - DNA, 25 bp, Artificial sequence
  Synthetic oligonucleotide
gggtgactagcgggcgtaatggcac

SEQ ID NO: 731240 - DNA, 25 bp, Artificial sequence
  Synthetic oligonucleotide
gggtgactagcgcgcgtaatggcac

SEQ ID NO: 731241 - DNA, 25 bp, Artificial sequence
  Synthetic oligonucleotide
gtcgtaccgcgccactataggtccc

SEQ ID NO: 731242 - DNA, 25 bp, Artificial sequence
  Synthetic oligonucleotide
gtcgtaccgcgcgactataggtccc

SEQ ID NO: 731243 - DNA, 25 bp, Artificial sequence
  Synthetic oligonucleotide
gggctgtacgtcgcgccaactcatg

SEQ ID NO: 731244 - DNA, 25 bp, Artificial sequence
  Synthetic oligonucleotide
gggctgtacgtcccgccaactcatg

SEQ ID NO: 731245 - DNA, 25 bp, Artificial sequence
  Synthetic oligonucleotide
gctggtatcgccggctagtagccca

SEQ ID NO: 731246 - DNA, 25 bp, Artificial sequence
  Synthetic oligonucleotide
gctggtatcgcccgctagtagccca

SEQ ID NO: 731247 - DNA, 25 bp, Artificial sequence
  Synthetic oligonucleotide
tacgcgcgtaagtgcggttcggtcc

SEQ ID NO: 731248 - DNA, 25 bp, Artificial sequence
  Synthetic oligonucleotide
gtggcactcttacgacgcggcttcc

SEQ ID NO: 731249 - DNA, 25 bp, Artificial sequence
  Synthetic oligonucleotide
tcaggcacgtccggacgtattgccg

SEQ ID NO: 731250 - DNA, 25 bp, Artificial sequence
  Synthetic oligonucleotide
gtggcactcttaggacgcggcttcc

SEQ ID NO: 731251 - DNA, 25 bp, Artificial sequence
  Synthetic oligonucleotide
gactgaagttcgcgtaggctcgggc

SEQ ID NO: 731252 - DNA, 25 bp, Artificial sequence
  Synthetic oligonucleotide
gactgaagttcgggtaggctcgggc

SEQ ID NO: 731253 - DNA, 25 bp, Artificial sequence
  Synthetic oligonucleotide
agggttcggccctatcgtagagcgg

SEQ ID NO: 731254 - DNA, 25 bp, Artificial sequence
  Synthetic oligonucleotide
agggttcggcccaatcgtagagcgg

SEQ ID NO: 731255 - DNA, 25 bp, Artificial sequence
  Synthetic oligonucleotide
ccatccacagcgtagcgcgttccga

SEQ ID NO: 731256 - DNA, 25 bp, Artificial sequence
  Synthetic oligonucleotide
ccatccacagcgaagcgcgttccga

SEQ ID NO: 731257 - DNA, 25 bp, Artificial sequence
  Synthetic oligonucleotide
ggcgggtgactcgcgtcgttcgttt

SEQ ID NO: 731258 - DNA, 25 bp, Artificial sequence
  Synthetic oligonucleotide
ggcgggtgactcccgtcgttcgttt

SEQ ID NO: 731259 - DNA, 25 bp, Artificial sequence
  Synthetic oligonucleotide
tccggcatagcccacggtcaacacc

SEQ ID NO: 731260 - DNA, 25 bp, Artificial sequence
  Synthetic oligonucleotide
tccggcatagccgacggtcaacacc

SEQ ID NO: 731261 - DNA, 25 bp, Artificial sequence
  Synthetic oligonucleotide
ttgcggcgcttaccggtaggacgct

SEQ ID NO: 731262 - DNA, 25 bp, Artificial sequence
  Synthetic oligonucleotide
tacgcgcgtaagagcggttcggtcc

SEQ ID NO: 731263 - DNA, 25 bp, Artificial sequence
  Synthetic oligonucleotide
acatcctccgcgacgggtaggagct

SEQ ID NO: 731264 - DNA, 25 bp, Artificial sequence
  Synthetic oligonucleotide
cgcactccgacgtcttacgggtgtc

SEQ ID NO: 731265 - DNA, 25 bp, Artificial sequence
  Synthetic oligonucleotide
caagggaaatcgccgcacggcctct

SEQ ID NO: 731266 - DNA, 25 bp, Artificial sequence
  Synthetic oligonucleotide
caagggaaatcggcgcacggcctct

SEQ ID NO: 731267 - DNA, 25 bp, Artificial sequence
  Synthetic oligonucleotide
ctgaggtcgcgctcttacggtgacc

SEQ ID NO: 731268 - DNA, 25 bp, Artificial sequence
  Synthetic oligonucleotide
ctgaggtcgcgcacttacggtgacc

SEQ ID NO: 731269 - DNA, 25 bp, Artificial sequence
  Synthetic oligonucleotide
ggcccttcgcgctaggtaggcagat

SEQ ID NO: 731270 - DNA, 25 bp, Artificial sequence
  Synthetic oligonucleotide
ggcccttcgcgcaaggtaggcagat

SEQ ID NO: 731271 - DNA, 25 bp, Artificial sequence
  Synthetic oligonucleotide
acgaagtatcgcccgggcgtacgtc

SEQ ID NO: 731272 - DNA, 25 bp, Artificial sequence
  Synthetic oligonucleotide
acgaagtatcgcgcgggcgtacgtc

SEQ ID NO: 731273 - DNA, 25 bp, Artificial sequence
  Synthetic oligonucleotide
ccggcacgataccgactggctaacg

SEQ ID NO: 731274 - DNA, 25 bp, Artificial sequence
  Synthetic oligonucleotide
ccggcacgatacggactggctaacg

SEQ ID NO: 731275 - DNA, 25 bp, Artificial sequence
  Synthetic oligonucleotide
cccggtaggtatggcgaacctgacc

SEQ ID NO: 731276 - DNA, 25 bp, Artificial sequence
  Synthetic oligonucleotide
aagcgaagccgttgtcgcgctgcct

SEQ ID NO: 731277 - DNA, 25 bp, Artificial sequence
  Synthetic oligonucleotide
cgcactccgacgacttacgggtgtc

SEQ ID NO: 731278 - DNA, 25 bp, Artificial sequence
  Synthetic oligonucleotide
acatcctccgcgtcgggtaggagct

SEQ ID NO: 731279 - DNA, 25 bp, Artificial sequence
  Synthetic oligonucleotide
tttgccttcgtcgaccgcgaggcgt

SEQ ID NO: 731280 - DNA, 25 bp, Artificial sequence
  Synthetic oligonucleotide
tttgccttcgtccaccgcgaggcgt

SEQ ID NO: 731281 - DNA, 25 bp, Artificial sequence
  Synthetic oligonucleotide
agacgccgataggggtccgttggac

SEQ ID NO: 731282 - DNA, 25 bp, Artificial sequence
  Synthetic oligonucleotide
agacgccgatagcggtccgttggac

SEQ ID NO: 731283 - DNA, 25 bp, Artificial sequence
  Synthetic oligonucleotide
acctgctcgcgctccgtagaaggga

SEQ ID NO: 731284 - DNA, 25 bp, Artificial sequence
  Synthetic oligonucleotide
acctgctcgcgcaccgtagaaggga

SEQ ID NO: 731285 - DNA, 25 bp, Artificial sequence
  Synthetic oligonucleotide
gattgcgccgacgtctatccgtcgc

SEQ ID NO: 731286 - DNA, 25 bp, Artificial sequence
  Synthetic oligonucleotide
gattgcgccgacctctatccgtcgc

SEQ ID NO: 731287 - DNA, 25 bp, Artificial sequence
  Synthetic oligonucleotide
caggagcgcgcattggtccgatcgt

SEQ ID NO: 731288 - DNA, 25 bp, Artificial sequence
  Synthetic oligonucleotide
caggagcgcgcaatggtccgatcgt

SEQ ID NO: 731289 - DNA, 25 bp, Artificial sequence
  Synthetic oligonucleotide
aagcgaagccgtagtcgcgctgcct

SEQ ID NO: 731290 - DNA, 25 bp, Artificial sequence
  Synthetic oligonucleotide
acgacgacgggaggtacgctgtcgt

SEQ ID NO: 731291 - DNA, 25 bp, Artificial sequence
  Synthetic oligonucleotide
cgttggtatccgagcgtcgacgcag

SEQ ID NO: 731292 - DNA, 25 bp, Artificial sequence
  Synthetic oligonucleotide
acggtccgcgcgtatgatcagtcgg

SEQ ID NO: 731293 - DNA, 25 bp, Artificial sequence
  Synthetic oligonucleotide
ggcctgcgcgccctgttatgaggaa

SEQ ID NO: 731294 - DNA, 25 bp, Artificial sequence
  Synthetic oligonucleotide
ggcctgcgcgccgtgttatgaggaa

SEQ ID NO: 731295 - DNA, 25 bp, Artificial sequence
  Synthetic oligonucleotide
gtccgcttcgacgccgcatgacaga

SEQ ID NO: 731296 - DNA, 25 bp, Artificial sequence
  Synthetic oligonucleotide
gtccgcttcgaccccgcatgacaga

SEQ ID NO: 731297 - DNA, 25 bp, Artificial sequence
  Synthetic oligonucleotide
ttcttggcgttatgcggaccgcccc

SEQ ID NO: 731298 - DNA, 25 bp, Artificial sequence
  Synthetic oligonucleotide
tcgagggttatgggcgatcggcagc

SEQ ID NO: 731299 - DNA, 25 bp, Artificial sequence
  Synthetic oligonucleotide
ttcttggcgttaagcggaccgcccc

SEQ ID NO: 731300 - DNA, 25 bp, Artificial sequence
  Synthetic oligonucleotide
acgacgacgggacgtacgctgtcgt

SEQ ID NO: 731301 - DNA, 25 bp, Artificial sequence
  Synthetic oligonucleotide
cacgccgcgctaggctgatataccc

SEQ ID NO: 731302 - DNA, 25 bp, Artificial sequence
  Synthetic oligonucleotide
cacgccgcgctacgctgatataccc

SEQ ID NO: 731303 - DNA, 25 bp, Artificial sequence
  Synthetic oligonucleotide
ctagcatcacgactacgcgcgggtc

SEQ ID NO: 731304 - DNA, 25 bp, Artificial sequence
  Synthetic oligonucleotide
ctagcatcacgagtacgcgcgggtc

SEQ ID NO: 731305 - DNA, 25 bp, Artificial sequence
  Synthetic oligonucleotide
cgacaatcgagcgctacgcgtacgc

SEQ ID NO: 731306 - DNA, 25 bp, Artificial sequence
  Synthetic oligonucleotide
cgacaatcgagccctacgcgtacgc

SEQ ID NO: 731307 - DNA, 25 bp, Artificial sequence
  Synthetic oligonucleotide
tcgagggttatgcgcgatcggcagc

SEQ ID NO: 731308 - DNA, 25 bp, Artificial sequence
  Synthetic oligonucleotide
agtcgcagcgtccgactaggctacg

SEQ ID NO: 731309 - DNA, 25 bp, Artificial sequence
  Synthetic oligonucleotide
ttgtcccgcgaggcataccccgatc

SEQ ID NO: 731310 - DNA, 25 bp, Artificial sequence
  Synthetic oligonucleotide
tgggaaactaacgcgcggcaagggc

SEQ ID NO: 731311 - DNA, 25 bp, Artificial sequence
  Synthetic oligonucleotide
cgcatctcgccaagacgcggaaacg

SEQ ID NO: 731312 - DNA, 25 bp, Artificial sequence
  Synthetic oligonucleotide
cgcatctcgccatgacgcggaaacg

SEQ ID NO: 731313 - DNA, 25 bp, Artificial sequence
  Synthetic oligonucleotide
tcgccttaggacgcgcgtactggag

SEQ ID NO: 731314 - DNA, 25 bp, Artificial sequence
  Synthetic oligonucleotide
tcgccttaggacccgcgtactggag

SEQ ID NO: 731315 - DNA, 25 bp, Artificial sequence
  Synthetic oligonucleotide
acggtccgcgcgaatgatcagtcgg

SEQ ID NO: 731316 - DNA, 25 bp, Artificial sequence
  Synthetic oligonucleotide
accgggggcggtttgtcgatcgatg

SEQ ID NO: 731317 - DNA, 25 bp, Artificial sequence
  Synthetic oligonucleotide
tggtccctagtacggtgcgggagct

SEQ ID NO: 731318 - DNA, 25 bp, Artificial sequence
  Synthetic oligonucleotide
agtcgcagcgtcggactaggctacg

SEQ ID NO: 731319 - DNA, 25 bp, Artificial sequence
  Synthetic oligonucleotide
agagaccgtgccctagcgagctctg

SEQ ID NO: 731320 - DNA, 25 bp, Artificial sequence
  Synthetic oligonucleotide
agagaccgtgccgtagcgagctctg

SEQ ID NO: 731321 - DNA, 25 bp, Artificial sequence
  Synthetic oligonucleotide
acgggtgtacgttgacgcgagtcgc

SEQ ID NO: 731322 - DNA, 25 bp, Artificial sequence
  Synthetic oligonucleotide
acgggtgtacgtagacgcgagtcgc

SEQ ID NO: 731323 - DNA, 25 bp, Artificial sequence
  Synthetic oligonucleotide
ggcgcgtatcgctgttacgggtctg

SEQ ID NO: 731324 - DNA, 25 bp, Artificial sequence
  Synthetic oligonucleotide
ggcgcgtatcgcagttacgggtctg

SEQ ID NO: 731325 - DNA, 25 bp, Artificial sequence
  Synthetic oligonucleotide
accgggggcggtatgtcgatcgatg

SEQ ID NO: 731326 - DNA, 25 bp, Artificial sequence
  Synthetic oligonucleotide
cgctcgcgtccgataaacgaaccgg

SEQ ID NO: 731327 - DNA, 25 bp, Artificial sequence
  Synthetic oligonucleotide
atctaacgacggtctcgcagccccg

SEQ ID NO: 731328 - DNA, 25 bp, Artificial sequence
  Synthetic oligonucleotide
ccaagctatcgcgcgacgtggttgg

SEQ ID NO: 731329 - DNA, 25 bp, Artificial sequence
  Synthetic oligonucleotide
ccaagctatcgcccgacgtggttgg

SEQ ID NO: 731330 - DNA, 25 bp, Artificial sequence
  Synthetic oligonucleotide
gtctgcgtcgtatggcgcgctctag

SEQ ID NO: 731331 - DNA, 25 bp, Artificial sequence
  Synthetic oligonucleotide
gtctgcgtcgtaaggcgcgctctag

SEQ ID NO: 731332 - DNA, 25 bp, Artificial sequence
  Synthetic oligonucleotide
agcggtgccgtactccgatcgctgt

SEQ ID NO: 731333 - DNA, 25 bp, Artificial sequence
  Synthetic oligonucleotide
cgtaccatcgtccggtcgttcggac

SEQ ID NO: 731334 - DNA, 25 bp, Artificial sequence
  Synthetic oligonucleotide
cgctcgcgtccgttaaacgaaccgg

SEQ ID NO: 731335 - DNA, 25 bp, Artificial sequence
  Synthetic oligonucleotide
gcactccggtcgtcaacggtacgca

SEQ ID NO: 731336 - DNA, 25 bp, Artificial sequence
  Synthetic oligonucleotide
agctctggcgtcggaacgagcgatc

SEQ ID NO: 731337 - DNA, 25 bp, Artificial sequence
  Synthetic oligonucleotide
agctctggcgtccgaacgagcgatc

SEQ ID NO: 731338 - DNA, 25 bp, Artificial sequence
  Synthetic oligonucleotide
gccgtgacgcgccttggatcgtaca

SEQ ID NO: 731339 - DNA, 25 bp, Artificial sequence
  Synthetic oligonucleotide
gccgtgacgcgcgttggatcgtaca

SEQ ID NO: 731340 - DNA, 25 bp, Artificial sequence
  Synthetic oligonucleotide
gagggctcagtagcggtcggacgaa

SEQ ID NO: 731341 - DNA, 25 bp, Artificial sequence
  Synthetic oligonucleotide
gagggctcagtaccggtcggacgaa

SEQ ID NO: 731342 - DNA, 25 bp, Artificial sequence
  Synthetic oligonucleotide
ttgtcccgcgagccataccccgatc

SEQ ID NO: 731343 - DNA, 25 bp, Artificial sequence
  Synthetic oligonucleotide
agcggtgccgtagtccgatcgctgt

SEQ ID NO: 731344 - DNA, 25 bp, Artificial sequence
  Synthetic oligonucleotide
gccaactagcgcggttccggatcag

SEQ ID NO: 731345 - DNA, 25 bp, Artificial sequence
  Synthetic oligonucleotide
cgttggtatccgtgcgtcgacgcag

SEQ ID NO: 731346 - DNA, 25 bp, Artificial sequence
  Synthetic oligonucleotide
tggtccctagtagggtgcgggagct

SEQ ID NO: 731347 - DNA, 25 bp, Artificial sequence
  Synthetic oligonucleotide
gaggcttcgacccgtagcgcaactg

SEQ ID NO: 731348 - DNA, 25 bp, Artificial sequence
  Synthetic oligonucleotide
gaggcttcgaccggtagcgcaactg

SEQ ID NO: 731349 - DNA, 25 bp, Artificial sequence
  Synthetic oligonucleotide
acccgagcgctcggtattgggaacg

SEQ ID NO: 731350 - DNA, 25 bp, Artificial sequence
  Synthetic oligonucleotide
acccgagcgctccgtattgggaacg

SEQ ID NO: 731351 - DNA, 25 bp, Artificial sequence
  Synthetic oligonucleotide
ccctaagtacgaccgtcgcccggat

SEQ ID NO: 731352 - DNA, 25 bp, Artificial sequence
  Synthetic oligonucleotide
atctaacgacggactcgcagccccg

SEQ ID NO: 731353 - DNA, 25 bp, Artificial sequence
  Synthetic oligonucleotide
gccaactagcgccgttccggatcag

SEQ ID NO: 731354 - DNA, 25 bp, Artificial sequence
  Synthetic oligonucleotide
gcactccggtcgacaacggtacgca

SEQ ID NO: 731355 - DNA, 25 bp, Artificial sequence
  Synthetic oligonucleotide
ccccccgttatagcgccggctgtat

SEQ ID NO: 731356 - DNA, 25 bp, Artificial sequence
  Synthetic oligonucleotide
ccccccgttataccgccggctgtat

SEQ ID NO: 731357 - DNA, 25 bp, Artificial sequence
  Synthetic oligonucleotide
cgcttccgcgtagcggataccacag

SEQ ID NO: 731358 - DNA, 25 bp, Artificial sequence
  Synthetic oligonucleotide
cgcttccgcgtaccggataccacag

SEQ ID NO: 731359 - DNA, 25 bp, Artificial sequence
  Synthetic oligonucleotide
cgtcctcgccgattacgcagaaggc

SEQ ID NO: 731360 - DNA, 25 bp, Artificial sequence
  Synthetic oligonucleotide
cgtcctcgccgaatacgcagaaggc

SEQ ID NO: 731361 - DNA, 25 bp, Artificial sequence
  Synthetic oligonucleotide
cgtaccatcgtcgggtcgttcggac

SEQ ID NO: 731362 - DNA, 25 bp, Artificial sequence
  Synthetic oligonucleotide
ccctaagtacgagcgtcgcccggat

SEQ ID NO: 731363 - DNA, 25 bp, Artificial sequence
  Synthetic oligonucleotide
gcgggtctcaataggcgcgatggag

SEQ ID NO: 731364 - DNA, 25 bp, Artificial sequence
  Synthetic oligonucleotide
tgggaaactaacccgcggcaagggc

SEQ ID NO: 731365 - DNA, 25 bp, Artificial sequence
  Synthetic oligonucleotide
ctggagtatacccggcggtcgcatc

SEQ ID NO: 731366 - DNA, 25 bp, Artificial sequence
  Synthetic oligonucleotide
ctggagtataccgggcggtcgcatc

SEQ ID NO: 731367 - DNA, 25 bp, Artificial sequence
  Synthetic oligonucleotide
tccagtatacgccgaacccccgcct

SEQ ID NO: 731368 - DNA, 25 bp, Artificial sequence
  Synthetic oligonucleotide
tccagtatacgcggaacccccgcct

SEQ ID NO: 731369 - DNA, 25 bp, Artificial sequence
  Synthetic oligonucleotide
cggcctactgtcgcgacacacggtt

SEQ ID NO: 731370 - DNA, 25 bp, Artificial sequence
  Synthetic oligonucleotide
aggaatcgtcacccgtaccgtgccg

SEQ ID NO: 731371 - DNA, 25 bp, Artificial sequence
  Synthetic oligonucleotide
gcgggtctcaattggcgcgatggag

SEQ ID NO: 731372 - DNA, 25 bp, Artificial sequence
  Synthetic oligonucleotide
gtcgtgcagtcgaccggtacttgcg

SEQ ID NO: 731373 - DNA, 25 bp, Artificial sequence
  Synthetic oligonucleotide
cggggaacgtcgtgaccggttcaga

SEQ ID NO: 731374 - DNA, 25 bp, Artificial sequence
  Synthetic oligonucleotide
cggggaacgtcgagaccggttcaga

SEQ ID NO: 731375 - DNA, 25 bp, Artificial sequence
  Synthetic oligonucleotide
ctacccttggcgagacgcgtcttcc

SEQ ID NO: 731376 - DNA, 25 bp, Artificial sequence
  Synthetic oligonucleotide
ctacccttggcgtgacgcgtcttcc

SEQ ID NO: 731377 - DNA, 25 bp, Artificial sequence
  Synthetic oligonucleotide
cgtccaacaccgctcgcatcgacgt

SEQ ID NO: 731378 - DNA, 25 bp, Artificial sequence
  Synthetic oligonucleotide
cgtccaacaccggtcgcatcgacgt

SEQ ID NO: 731379 - DNA, 25 bp, Artificial sequence
  Synthetic oligonucleotide
cgctggacccgtttcgcaccttcca

SEQ ID NO: 731380 - DNA, 25 bp, Artificial sequence
  Synthetic oligonucleotide
cggcctactgtcccgacacacggtt

SEQ ID NO: 731381 - DNA, 25 bp, Artificial sequence
  Synthetic oligonucleotide
gtgcccactacgacgcgctacctca

SEQ ID NO: 731382 - DNA, 25 bp, Artificial sequence
  Synthetic oligonucleotide
cggacccgcgacgcctatatcctga

SEQ ID NO: 731383 - DNA, 25 bp, Artificial sequence
  Synthetic oligonucleotide
cggtgccataccgcgccgacatcaa

SEQ ID NO: 731384 - DNA, 25 bp, Artificial sequence
  Synthetic oligonucleotide
cggtgccataccccgccgacatcaa

SEQ ID NO: 731385 - DNA, 25 bp, Artificial sequence
  Synthetic oligonucleotide
gtacagttacgagcgcggaccgtgc

SEQ ID NO: 731386 - DNA, 25 bp, Artificial sequence
  Synthetic oligonucleotide
gtacagttacgaccgcggaccgtgc

SEQ ID NO: 731387 - DNA, 25 bp, Artificial sequence
  Synthetic oligonucleotide
gccctgtacttcccggtcgcttcct

SEQ ID NO: 731388 - DNA, 25 bp, Artificial sequence
  Synthetic oligonucleotide
aggaatcgtcacgcgtaccgtgccg

SEQ ID NO: 731389 - DNA, 25 bp, Artificial sequence
  Synthetic oligonucleotide
gtgcccactacgtcgcgctacctca

SEQ ID NO: 731390 - DNA, 25 bp, Artificial sequence
  Synthetic oligonucleotide
ctcggacacgacggtaacgcgtacc

SEQ ID NO: 731391 - DNA, 25 bp, Artificial sequence
  Synthetic oligonucleotide
ttcgctggcgtcgcgactacgtcac

SEQ ID NO: 731392 - DNA, 25 bp, Artificial sequence
  Synthetic oligonucleotide
ttcgctggcgtcccgactacgtcac

SEQ ID NO: 731393 - DNA, 25 bp, Artificial sequence
  Synthetic oligonucleotide
gcggacacgaccgctacgtttcagc

SEQ ID NO: 731394 - DNA, 25 bp, Artificial sequence
  Synthetic oligonucleotide
gcggacacgacccctacgtttcagc

SEQ ID NO: 731395 - DNA, 25 bp, Artificial sequence
  Synthetic oligonucleotide
tcgcgtccgcggtcgtcaaaaggac

SEQ ID NO: 731396 - DNA, 25 bp, Artificial sequence
  Synthetic oligonucleotide
tcgcgtccgcggacgtcaaaaggac

SEQ ID NO: 731397 - DNA, 25 bp, Artificial sequence
  Synthetic oligonucleotide
gtcgtgcagtcgtccggtacttgcg

SEQ ID NO: 731398 - DNA, 25 bp, Artificial sequence
  Synthetic oligonucleotide
gccctgtacttcgcggtcgcttcct

SEQ ID NO: 731399 - DNA, 25 bp, Artificial sequence
  Synthetic oligonucleotide
gcttgcggtcgaccgtatgttcccg

SEQ ID NO: 731400 - DNA, 25 bp, Artificial sequence
  Synthetic oligonucleotide
gacgaagacctatctcgcggtccgc

SEQ ID NO: 731401 - DNA, 25 bp, Artificial sequence
  Synthetic oligonucleotide
gacgaagacctaactcgcggtccgc

SEQ ID NO: 731402 - DNA, 25 bp, Artificial sequence
  Synthetic oligonucleotide
ggggcgttcggactatcggttcagg

SEQ ID NO: 731403 - DNA, 25 bp, Artificial sequence
  Synthetic oligonucleotide
ggggcgttcggagtatcggttcagg

SEQ ID NO: 731404 - DNA, 25 bp, Artificial sequence
  Synthetic oligonucleotide
tcgccaggacgctatacgctgagcg

SEQ ID NO: 731405 - DNA, 25 bp, Artificial sequence
  Synthetic oligonucleotide
tcgccaggacgcaatacgctgagcg

SEQ ID NO: 731406 - DNA, 25 bp, Artificial sequence
  Synthetic oligonucleotide
cgctggacccgtatcgcaccttcca

SEQ ID NO: 731407 - DNA, 25 bp, Artificial sequence
  Synthetic oligonucleotide
ggacataacgcgggccgatcaacgg

SEQ ID NO: 731408 - DNA, 25 bp, Artificial sequence
  Synthetic oligonucleotide
tcgatcgtacacggcaacgacgggc

SEQ ID NO: 731409 - DNA, 25 bp, Artificial sequence
  Synthetic oligonucleotide
gcttgcggtcgagcgtatgttcccg

SEQ ID NO: 731410 - DNA, 25 bp, Artificial sequence
  Synthetic oligonucleotide
tggcgttcgcggggtacctttccgt

SEQ ID NO: 731411 - DNA, 25 bp, Artificial sequence
  Synthetic oligonucleotide
tggcgttcgcggcgtacctttccgt

SEQ ID NO: 731412 - DNA, 25 bp, Artificial sequence
  Synthetic oligonucleotide
gcacgttacggcccggttgcgatac

SEQ ID NO: 731413 - DNA, 25 bp, Artificial sequence
  Synthetic oligonucleotide
gcacgttacggcgcggttgcgatac

SEQ ID NO: 731414 - DNA, 25 bp, Artificial sequence
  Synthetic oligonucleotide
gggcgacgcgtactgacggaaacca

SEQ ID NO: 731415 - DNA, 25 bp, Artificial sequence
  Synthetic oligonucleotide
gggcgacgcgtagtgacggaaacca

SEQ ID NO: 731416 - DNA, 25 bp, Artificial sequence
  Synthetic oligonucleotide
ggacataacgcgcgccgatcaacgg

SEQ ID NO: 731417 - DNA, 25 bp, Artificial sequence
  Synthetic oligonucleotide
gggtcgctcgtcccgtacggagtaa

SEQ ID NO: 731418 - DNA, 25 bp, Artificial sequence
  Synthetic oligonucleotide
ttcgcgtagtccggtcgtacggcct

SEQ ID NO: 731419 - DNA, 25 bp, Artificial sequence
  Synthetic oligonucleotide
ccatgtgcgtgccgcggtagcatga

SEQ ID NO: 731420 - DNA, 25 bp, Artificial sequence
  Synthetic oligonucleotide
ccatgtgcgtgcggcggtagcatga

SEQ ID NO: 731421 - DNA, 25 bp, Artificial sequence
  Synthetic oligonucleotide
accaagccgcttgggtacgtctggc

SEQ ID NO: 731422 - DNA, 25 bp, Artificial sequence
  Synthetic oligonucleotide
accaagccgcttcggtacgtctggc

SEQ ID NO: 731423 - DNA, 25 bp, Artificial sequence
  Synthetic oligonucleotide
ccccacgtccgccatacacaagcga

SEQ ID NO: 731424 - DNA, 25 bp, Artificial sequence
  Synthetic oligonucleotide
ccccacgtccgcgatacacaagcga

SEQ ID NO: 731425 - DNA, 25 bp, Artificial sequence
  Synthetic oligonucleotide
cggccccatcgaacgtacgcctagt

SEQ ID NO: 731426 - DNA, 25 bp, Artificial sequence
  Synthetic oligonucleotide
gcagtattggaccgtcgcggctcag

SEQ ID NO: 731427 - DNA, 25 bp, Artificial sequence
  Synthetic oligonucleotide
cggccccatcgatcgtacgcctagt

SEQ ID NO: 731428 - DNA, 25 bp, Artificial sequence
  Synthetic oligonucleotide
ttcgcgtagtcccgtcgtacggcct

SEQ ID NO: 731429 - DNA, 25 bp, Artificial sequence
  Synthetic oligonucleotide
agcggatacgatcgacgcatggccg

SEQ ID NO: 731430 - DNA, 25 bp, Artificial sequence
  Synthetic oligonucleotide
agcggatacgatggacgcatggccg

SEQ ID NO: 731431 - DNA, 25 bp, Artificial sequence
  Synthetic oligonucleotide
gcgttcgtccgtggtagcgtgcaga

SEQ ID NO: 731432 - DNA, 25 bp, Artificial sequence
  Synthetic oligonucleotide
gcgttcgtccgtcgtagcgtgcaga

SEQ ID NO: 731433 - DNA, 25 bp, Artificial sequence
  Synthetic oligonucleotide
tcgatcgtacaccgcaacgacgggc

SEQ ID NO: 731434 - DNA, 25 bp, Artificial sequence
  Synthetic oligonucleotide
ctcggacacgaccgtaacgcgtacc

SEQ ID NO: 731435 - DNA, 25 bp, Artificial sequence
  Synthetic oligonucleotide
gcagtattggacggtcgcggctcag

SEQ ID NO: 731436 - DNA, 25 bp, Artificial sequence
  Synthetic oligonucleotide
acggagttacgcgacctacgcgtcc

SEQ ID NO: 731437 - DNA, 25 bp, Artificial sequence
  Synthetic oligonucleotide
cgcttatagcgtacgtcgcccgtgc

SEQ ID NO: 731438 - DNA, 25 bp, Artificial sequence
  Synthetic oligonucleotide
agccaatgcctatcgcgcccatggg

SEQ ID NO: 731439 - DNA, 25 bp, Artificial sequence
  Synthetic oligonucleotide
ccgagtttaactgcgcgcggccatc

SEQ ID NO: 731440 - DNA, 25 bp, Artificial sequence
  Synthetic oligonucleotide
ccgagtttaactccgcgcggccatc

SEQ ID NO: 731441 - DNA, 25 bp, Artificial sequence
  Synthetic oligonucleotide
cctcgtccgcgttgcgttggcagta

SEQ ID NO: 731442 - DNA, 25 bp, Artificial sequence
  Synthetic oligonucleotide
cctcgtccgcgtagcgttggcagta

SEQ ID NO: 731443 - DNA, 25 bp, Artificial sequence
  Synthetic oligonucleotide
tcgtcagggcgttctcgcacagctc

SEQ ID NO: 731444 - DNA, 25 bp, Artificial sequence
  Synthetic oligonucleotide
ctgtgaaccgaccgcgaatgcacgg

SEQ ID NO: 731445 - DNA, 25 bp, Artificial sequence
  Synthetic oligonucleotide
tcgtcagggcgtactcgcacagctc

SEQ ID NO: 731446 - DNA, 25 bp, Artificial sequence
  Synthetic oligonucleotide
acggagttacgccacctacgcgtcc

SEQ ID NO: 731447 - DNA, 25 bp, Artificial sequence
  Synthetic oligonucleotide
agtgccacgcgtcgatagcgtggag

SEQ ID NO: 731448 - DNA, 25 bp, Artificial sequence
  Synthetic oligonucleotide
agtgccacgcgtggatagcgtggag

SEQ ID NO: 731449 - DNA, 25 bp, Artificial sequence
  Synthetic oligonucleotide
cgcacttctacgcgcgtcgaccagt

SEQ ID NO: 731450 - DNA, 25 bp, Artificial sequence
  Synthetic oligonucleotide
cgcacttctacgggcgtcgaccagt

SEQ ID NO: 731451 - DNA, 25 bp, Artificial sequence
  Synthetic oligonucleotide
ggtacgccgacgggtacttcggcta

SEQ ID NO: 731452 - DNA, 25 bp, Artificial sequence
  Synthetic oligonucleotide
ggtacgccgacgcgtacttcggcta

SEQ ID NO: 731453 - DNA, 25 bp, Artificial sequence
  Synthetic oligonucleotide
ctgtgaaccgacggcgaatgcacgg

SEQ ID NO: 731454 - DNA, 25 bp, Artificial sequence
  Synthetic oligonucleotide
ccgctgactagaacggcgcagccta

SEQ ID NO: 731455 - DNA, 25 bp, Artificial sequence
  Synthetic oligonucleotide
gggcattaacgacgtccgccgctca

SEQ ID NO: 731456 - DNA, 25 bp, Artificial sequence
  Synthetic oligonucleotide
gggcattaacgaggtccgccgctca

SEQ ID NO: 731457 - DNA, 25 bp, Artificial sequence
  Synthetic oligonucleotide
cccagcacgcgtagtaccggggtta

SEQ ID NO: 731458 - DNA, 25 bp, Artificial sequence
  Synthetic oligonucleotide
cccagcacgcgttgtaccggggtta

SEQ ID NO: 731459 - DNA, 25 bp, Artificial sequence
  Synthetic oligonucleotide
ccacacatcggtggcgcacgggaat

SEQ ID NO: 731460 - DNA, 25 bp, Artificial sequence
  Synthetic oligonucleotide
ccacacatcggtcgcgcacgggaat

SEQ ID NO: 731461 - DNA, 25 bp, Artificial sequence
  Synthetic oligonucleotide
agccaatgcctaacgcgcccatggg

SEQ ID NO: 731462 - DNA, 25 bp, Artificial sequence
  Synthetic oligonucleotide
aaacaccgttaccaccgcgcctggc

SEQ ID NO: 731463 - DNA, 25 bp, Artificial sequence
  Synthetic oligonucleotide
caccacgtaccggtacgaccctagc

SEQ ID NO: 731464 - DNA, 25 bp, Artificial sequence
  Synthetic oligonucleotide
ccgctgactagatcggcgcagccta

SEQ ID NO: 731465 - DNA, 25 bp, Artificial sequence
  Synthetic oligonucleotide
gaaccattacgcacggcgacaccgc

SEQ ID NO: 731466 - DNA, 25 bp, Artificial sequence
  Synthetic oligonucleotide
gaaccattacgctcggcgacaccgc

SEQ ID NO: 731467 - DNA, 25 bp, Artificial sequence
  Synthetic oligonucleotide
cacaccgctacgtcggacagctcga

SEQ ID NO: 731468 - DNA, 25 bp, Artificial sequence
  Synthetic oligonucleotide
cacaccgctacgacggacagctcga

SEQ ID NO: 731469 - DNA, 25 bp, Artificial sequence
  Synthetic oligonucleotide
gtaagccccgtcccgtacggatcca

SEQ ID NO: 731470 - DNA, 25 bp, Artificial sequence
  Synthetic oligonucleotide
gtaagccccgtcgcgtacggatcca

SEQ ID NO: 731471 - DNA, 25 bp, Artificial sequence
  Synthetic oligonucleotide
aaacaccgttacgaccgcgcctggc

SEQ ID NO: 731472 - DNA, 25 bp, Artificial sequence
  Synthetic oligonucleotide
gaatcgaggtccgtagcgcagcgca

SEQ ID NO: 731473 - DNA, 25 bp, Artificial sequence
  Synthetic oligonucleotide
gggagacgacgttgcgcgatgctct

SEQ ID NO: 731474 - DNA, 25 bp, Artificial sequence
  Synthetic oligonucleotide
gggagacgacgtagcgcgatgctct

SEQ ID NO: 731475 - DNA, 25 bp, Artificial sequence
  Synthetic oligonucleotide
tggaagtcgagcgtgatcggggcct

SEQ ID NO: 731476 - DNA, 25 bp, Artificial sequence
  Synthetic oligonucleotide
tggaagtcgagcctgatcggggcct

SEQ ID NO: 731477 - DNA, 25 bp, Artificial sequence
  Synthetic oligonucleotide
tcccgtcacgcggtatcgtaggtgc

SEQ ID NO: 731478 - DNA, 25 bp, Artificial sequence
  Synthetic oligonucleotide
tcccgtcacgcgctatcgtaggtgc

SEQ ID NO: 731479 - DNA, 25 bp, Artificial sequence
  Synthetic oligonucleotide
ggctcgtaacgccacgttgctggtg

SEQ ID NO: 731480 - DNA, 25 bp, Artificial sequence
  Synthetic oligonucleotide
ccggaagtccggacgtacgaagcga

SEQ ID NO: 731481 - DNA, 25 bp, Artificial sequence
  Synthetic oligonucleotide
ctctgctatgcccaccgttcacggg

SEQ ID NO: 731482 - DNA, 25 bp, Artificial sequence
  Synthetic oligonucleotide
gaatcgaggtccctagcgcagcgca

SEQ ID NO: 731483 - DNA, 25 bp, Artificial sequence
  Synthetic oligonucleotide
tgcaaccgtaacggccgaagccggt

SEQ ID NO: 731484 - DNA, 25 bp, Artificial sequence
  Synthetic oligonucleotide
tgcaaccgtaaccgccgaagccggt

SEQ ID NO: 731485 - DNA, 25 bp, Artificial sequence
  Synthetic oligonucleotide
ccgagcgggtctcgtacgacggtaa

SEQ ID NO: 731486 - DNA, 25 bp, Artificial sequence
  Synthetic oligonucleotide
ccgagcgggtctggtacgacggtaa

SEQ ID NO: 731487 - DNA, 25 bp, Artificial sequence
  Synthetic oligonucleotide
gagaacacgcgccacgtagcgagtc

SEQ ID NO: 731488 - DNA, 25 bp, Artificial sequence
  Synthetic oligonucleotide
gggtcgctcgtcgcgtacggagtaa

SEQ ID NO: 731489 - DNA, 25 bp, Artificial sequence
  Synthetic oligonucleotide
ccggaagtccggtcgtacgaagcga

SEQ ID NO: 731490 - DNA, 25 bp, Artificial sequence
  Synthetic oligonucleotide
gtgggcagttatttcgcgcgacccg

SEQ ID NO: 731491 - DNA, 25 bp, Artificial sequence
  Synthetic oligonucleotide
gtgggcagttatatcgcgcgacccg

SEQ ID NO: 731492 - DNA, 25 bp, Artificial sequence
  Synthetic oligonucleotide
tcggcataagcccgccgtaggcaga

SEQ ID NO: 731493 - DNA, 25 bp, Artificial sequence
  Synthetic oligonucleotide
caccacgtaccgctacgaccctagc

SEQ ID NO: 731494 - DNA, 25 bp, Artificial sequence
  Synthetic oligonucleotide
tgctagggtccgcaacgttgccgca

SEQ ID NO: 731495 - DNA, 25 bp, Artificial sequence
  Synthetic oligonucleotide
tgctagggtccggaacgttgccgca

SEQ ID NO: 731496 - DNA, 25 bp, Artificial sequence
  Synthetic oligonucleotide
ggaccccgtatagtcgggcctatcg

SEQ ID NO: 731497 - DNA, 25 bp, Artificial sequence
  Synthetic oligonucleotide
ggaccccgtatactcgggcctatcg

SEQ ID NO: 731498 - DNA, 25 bp, Artificial sequence
  Synthetic oligonucleotide
agcatggacgtatcgcgcgtctccc

SEQ ID NO: 731499 - DNA, 25 bp, Artificial sequence
  Synthetic oligonucleotide
gtagaacgttgtacccgcgcgtggg

SEQ ID NO: 731500 - DNA, 25 bp, Artificial sequence
  Synthetic oligonucleotide
agcatggacgtaacgcgcgtctccc

SEQ ID NO: 731501 - DNA, 25 bp, Artificial sequence
  Synthetic oligonucleotide
ggtgggcctagcgcggtttcccaaa

SEQ ID NO: 731502 - DNA, 25 bp, Artificial sequence
  Synthetic oligonucleotide
ctgagccgagccgactatcttccgg

SEQ ID NO: 731503 - DNA, 25 bp, Artificial sequence
  Synthetic oligonucleotide
ctgagccgagcccactatcttccgg

SEQ ID NO: 731504 - DNA, 25 bp, Artificial sequence
  Synthetic oligonucleotide
gtccgcacattacgcgcccgctaac

SEQ ID NO: 731505 - DNA, 25 bp, Artificial sequence
  Synthetic oligonucleotide
gtccgcacattaggcgcccgctaac

SEQ ID NO: 731506 - DNA, 25 bp, Artificial sequence
  Synthetic oligonucleotide
ctctgctatgccgaccgttcacggg

SEQ ID NO: 731507 - DNA, 25 bp, Artificial sequence
  Synthetic oligonucleotide
ggctcgtaacgcgacgttgctggtg

SEQ ID NO: 731508 - DNA, 25 bp, Artificial sequence
  Synthetic oligonucleotide
gtagaacgttgttcccgcgcgtggg

SEQ ID NO: 731509 - DNA, 25 bp, Artificial sequence
  Synthetic oligonucleotide
ggctagacgtagtaccgggatccgc

SEQ ID NO: 731510 - DNA, 25 bp, Artificial sequence
  Synthetic oligonucleotide
atgaggcgtacgcgcgttctcccga

SEQ ID NO: 731511 - DNA, 25 bp, Artificial sequence
  Synthetic oligonucleotide
atgaggcgtacgggcgttctcccga

SEQ ID NO: 731512 - DNA, 25 bp, Artificial sequence
  Synthetic oligonucleotide
ctccctcccgtagcgcatagcctgt

SEQ ID NO: 731513 - DNA, 25 bp, Artificial sequence
  Synthetic oligonucleotide
ctccctcccgtaccgcatagcctgt

SEQ ID NO: 731514 - DNA, 25 bp, Artificial sequence
  Synthetic oligonucleotide
tgtcactcggtaggagcgtgccgtc

SEQ ID NO: 731515 - DNA, 25 bp, Artificial sequence
  Synthetic oligonucleotide
tgtcactcggtacgagcgtgccgtc

SEQ ID NO: 731516 - DNA, 25 bp, Artificial sequence
  Synthetic oligonucleotide
cggatgacgcggaccagttgtggac

SEQ ID NO: 731517 - DNA, 25 bp, Artificial sequence
  Synthetic oligonucleotide
cgtcgagtacacccgtccggagttg

SEQ ID NO: 731518 - DNA, 25 bp, Artificial sequence
  Synthetic oligonucleotide
ctgaggattatcgcgcggcgatcgc

SEQ ID NO: 731519 - DNA, 25 bp, Artificial sequence
  Synthetic oligonucleotide
ggctagacgtagaaccgggatccgc

SEQ ID NO: 731520 - DNA, 25 bp, Artificial sequence
  Synthetic oligonucleotide
tcatgcgaaccgaacgacggcgcga

SEQ ID NO: 731521 - DNA, 25 bp, Artificial sequence
  Synthetic oligonucleotide
tcatgcgaaccgtacgacggcgcga

SEQ ID NO: 731522 - DNA, 25 bp, Artificial sequence
  Synthetic oligonucleotide
ggcagctacgtcgaacccgaatccc

SEQ ID NO: 731523 - DNA, 25 bp, Artificial sequence
  Synthetic oligonucleotide
ggcagctacgtccaacccgaatccc

SEQ ID NO: 731524 - DNA, 25 bp, Artificial sequence
  Synthetic oligonucleotide
ctaggcgcgacgaggtaccttaccg

SEQ ID NO: 731525 - DNA, 25 bp, Artificial sequence
  Synthetic oligonucleotide
ctaggcgcgacgtggtaccttaccg

SEQ ID NO: 731526 - DNA, 25 bp, Artificial sequence
  Synthetic oligonucleotide
cgtcgagtacacgcgtccggagttg

SEQ ID NO: 731527 - DNA, 25 bp, Artificial sequence
  Synthetic oligonucleotide
gcaagcctatgcacgcgcgctagtg

SEQ ID NO: 731528 - DNA, 25 bp, Artificial sequence
  Synthetic oligonucleotide
gagaacacgcgcgacgtagcgagtc

SEQ ID NO: 731529 - DNA, 25 bp, Artificial sequence
  Synthetic oligonucleotide
taccgggtcgcgtatacacccgtcg

SEQ ID NO: 731530 - DNA, 25 bp, Artificial sequence
  Synthetic oligonucleotide
ggtgggcctagcccggtttcccaaa

SEQ ID NO: 731531 - DNA, 25 bp, Artificial sequence
  Synthetic oligonucleotide
cgcttatagcgttcgtcgcccgtgc

SEQ ID NO: 731532 - DNA, 25 bp, Artificial sequence
  Synthetic oligonucleotide
taccgggtcgcgaatacacccgtcg

SEQ ID NO: 731533 - DNA, 25 bp, Artificial sequence
  Synthetic oligonucleotide
ggtatctcggacgcgtagtcggcgt

SEQ ID NO: 731534 - DNA, 25 bp, Artificial sequence
  Synthetic oligonucleotide
ggtatctcggacccgtagtcggcgt

SEQ ID NO: 731535 - DNA, 25 bp, Artificial sequence
  Synthetic oligonucleotide
tacgggcgtgacgtccgatccagca

SEQ ID NO: 731536 - DNA, 25 bp, Artificial sequence
  Synthetic oligonucleotide
cagcagcgttcgcactacatcgggc

SEQ ID NO: 731537 - DNA, 25 bp, Artificial sequence
  Synthetic oligonucleotide
tacgggcgtgacctccgatccagca

SEQ ID NO: 731538 - DNA, 25 bp, Artificial sequence
  Synthetic oligonucleotide
gcaagcctatgctcgcgcgctagtg

SEQ ID NO: 731539 - DNA, 25 bp, Artificial sequence
  Synthetic oligonucleotide
gtcatctatggcgcgcgctcgagga

SEQ ID NO: 731540 - DNA, 25 bp, Artificial sequence
  Synthetic oligonucleotide
gtcatctatggcccgcgctcgagga

SEQ ID NO: 731541 - DNA, 25 bp, Artificial sequence
  Synthetic oligonucleotide
acctcgcgtcgtactagcgcgcaag

SEQ ID NO: 731542 - DNA, 25 bp, Artificial sequence
  Synthetic oligonucleotide
acctcgcgtcgttctagcgcgcaag

SEQ ID NO: 731543 - DNA, 25 bp, Artificial sequence
  Synthetic oligonucleotide
agccgctctcgcctaccgtcatcct

SEQ ID NO: 731544 - DNA, 25 bp, Artificial sequence
  Synthetic oligonucleotide
ctgaggattatcccgcggcgatcgc

SEQ ID NO: 731545 - DNA, 25 bp, Artificial sequence
  Synthetic oligonucleotide
cagcagcgttcggactacatcgggc

SEQ ID NO: 731546 - DNA, 25 bp, Artificial sequence
  Synthetic oligonucleotide
cagatgcgccgttgggtaagtcccg

SEQ ID NO: 731547 - DNA, 25 bp, Artificial sequence
  Synthetic oligonucleotide
cacctcataccgcacgcgttcggtc

SEQ ID NO: 731548 - DNA, 25 bp, Artificial sequence
  Synthetic oligonucleotide
cacctcataccggacgcgttcggtc

SEQ ID NO: 731549 - DNA, 25 bp, Artificial sequence
  Synthetic oligonucleotide
gcccagaatccgggcgacaggaagt

SEQ ID NO: 731550 - DNA, 25 bp, Artificial sequence
  Synthetic oligonucleotide
gcccagaatccgcgcgacaggaagt

SEQ ID NO: 731551 - DNA, 25 bp, Artificial sequence
  Synthetic oligonucleotide
gcttgtccgtggtacgcgaacgtgc

SEQ ID NO: 731552 - DNA, 25 bp, Artificial sequence
  Synthetic oligonucleotide
gctggagacctaggtaccgcaccac

SEQ ID NO: 731553 - DNA, 25 bp, Artificial sequence
  Synthetic oligonucleotide
ggccatgcgcgtttaaccgggtagg

SEQ ID NO: 731554 - DNA, 25 bp, Artificial sequence
  Synthetic oligonucleotide
gccgtacgcgtttcgacgtggcgta

SEQ ID NO: 731555 - DNA, 25 bp, Artificial sequence
  Synthetic oligonucleotide
cagatgcgccgtagggtaagtcccg

SEQ ID NO: 731556 - DNA, 25 bp, Artificial sequence
  Synthetic oligonucleotide
gcttgtccgtggaacgcgaacgtgc

SEQ ID NO: 731557 - DNA, 25 bp, Artificial sequence
  Synthetic oligonucleotide
aagcagtgtaccaccggcggggact

SEQ ID NO: 731558 - DNA, 25 bp, Artificial sequence
  Synthetic oligonucleotide
aagcagtgtacctccggcggggact

SEQ ID NO: 731559 - DNA, 25 bp, Artificial sequence
  Synthetic oligonucleotide
cggatgacgcggtccagttgtggac

SEQ ID NO: 731560 - DNA, 25 bp, Artificial sequence
  Synthetic oligonucleotide
agccgctctcgcgtaccgtcatcct

SEQ ID NO: 731561 - DNA, 25 bp, Artificial sequence
  Synthetic oligonucleotide
ggctcgcgttaggggatgcaaaccg

SEQ ID NO: 731562 - DNA, 25 bp, Artificial sequence
  Synthetic oligonucleotide
ggctcgcgttagcggatgcaaaccg

SEQ ID NO: 731563 - DNA, 25 bp, Artificial sequence
  Synthetic oligonucleotide
gcactcacgtcggacgtcccatcac

SEQ ID NO: 731564 - DNA, 25 bp, Artificial sequence
  Synthetic oligonucleotide
gcactcacgtcgcacgtcccatcac

SEQ ID NO: 731565 - DNA, 25 bp, Artificial sequence
  Synthetic oligonucleotide
ggccatgcgcgtataaccgggtagg

SEQ ID NO: 731566 - DNA, 25 bp, Artificial sequence
  Synthetic oligonucleotide
atccccttagcgtacgcgggcgtct

SEQ ID NO: 731567 - DNA, 25 bp, Artificial sequence
  Synthetic oligonucleotide
tcaccataaccacgtcgcgtggcgg

SEQ ID NO: 731568 - DNA, 25 bp, Artificial sequence
  Synthetic oligonucleotide
tcaccataaccaggtcgcgtggcgg

SEQ ID NO: 731569 - DNA, 25 bp, Artificial sequence
  Synthetic oligonucleotide
gctggagacctacgtaccgcaccac

SEQ ID NO: 731570 - DNA, 25 bp, Artificial sequence
  Synthetic oligonucleotide
ggtgccagtctacgcgacgagttcc

SEQ ID NO: 731571 - DNA, 25 bp, Artificial sequence
  Synthetic oligonucleotide
gccgtacgcgttacgacgtggcgta

SEQ ID NO: 731572 - DNA, 25 bp, Artificial sequence
  Synthetic oligonucleotide
tcgggggtgcgaacgaccggctatt

SEQ ID NO: 731573 - DNA, 25 bp, Artificial sequence
  Synthetic oligonucleotide
tcgggggtgcgatcgaccggctatt

SEQ ID NO: 731574 - DNA, 25 bp, Artificial sequence
  Synthetic oligonucleotide
atccccttagcgaacgcgggcgtct

SEQ ID NO: 731575 - DNA, 25 bp, Artificial sequence
  Synthetic oligonucleotide
ggtgccagtctaggcgacgagttcc

SEQ ID NO: 731576 - DNA, 25 bp, Artificial sequence
  Synthetic oligonucleotide
tcggcccgaagttcgctcgtgactg

SEQ ID NO: 731577 - DNA, 25 bp, Artificial sequence
  Synthetic oligonucleotide
ggcatgccgcgacgtacgtacggat

SEQ ID NO: 731578 - DNA, 25 bp, Artificial sequence
  Synthetic oligonucleotide
ggcatgccgcgaggtacgtacggat

SEQ ID NO: 731579 - DNA, 25 bp, Artificial sequence
  Synthetic oligonucleotide
tcggcccgaagtacgctcgtgactg

SEQ ID NO: 731580 - DNA, 25 bp, Artificial sequence
  Synthetic oligonucleotide
cccctaccgtaagtagccggctgtg

SEQ ID NO: 731581 - DNA, 25 bp, Artificial sequence
  Synthetic oligonucleotide
cccctaccgtaactagccggctgtg

SEQ ID NO: 731582 - DNA, 25 bp, Artificial sequence
  Synthetic oligonucleotide
cggtccgcggttcgcggaatgatcg

SEQ ID NO: 731583 - DNA, 25 bp, Artificial sequence
  Synthetic oligonucleotide
tctggacgtacgtccgcgtcgggtg

SEQ ID NO: 731584 - DNA, 25 bp, Artificial sequence
  Synthetic oligonucleotide
cggtccgcggttggcggaatgatcg

SEQ ID NO: 731585 - DNA, 25 bp, Artificial sequence
  Synthetic oligonucleotide
gtgctgtcggacgtgcgagcgttgc

SEQ ID NO: 731586 - DNA, 25 bp, Artificial sequence
  Synthetic oligonucleotide
tcagtgagcgggacgtacgggtgcc

SEQ ID NO: 731587 - DNA, 25 bp, Artificial sequence
  Synthetic oligonucleotide
agaggtgtccggggtcataccccgc

SEQ ID NO: 731588 - DNA, 25 bp, Artificial sequence
  Synthetic oligonucleotide
tcagtgagcgggtcgtacgggtgcc

SEQ ID NO: 731589 - DNA, 25 bp, Artificial sequence
  Synthetic oligonucleotide
gtgctgtcggacctgcgagcgttgc

SEQ ID NO: 731590 - DNA, 25 bp, Artificial sequence
  Synthetic oligonucleotide
agaggtgtccggcgtcataccccgc

SEQ ID NO: 731591 - DNA, 25 bp, Artificial sequence
  Synthetic oligonucleotide
ttggggcgcgtaggatgtcgccgct

SEQ ID NO: 731592 - DNA, 25 bp, Artificial sequence
  Synthetic oligonucleotide
ttggggcgcgtacgatgtcgccgct

SEQ ID NO: 731593 - DNA, 25 bp, Artificial sequence
  Synthetic oligonucleotide
gctcctgcgtcgggctataggggtg

SEQ ID NO: 731594 - DNA, 25 bp, Artificial sequence
  Synthetic oligonucleotide
tctggacgtacgaccgcgtcgggtg

SEQ ID NO: 731595 - DNA, 25 bp, Artificial sequence
  Synthetic oligonucleotide
aggtcgcgaccacggtacgagtggc

SEQ ID NO: 731596 - DNA, 25 bp, Artificial sequence
  Synthetic oligonucleotide
gactcgatagccgcgcgcgagctac

SEQ ID NO: 731597 - DNA, 25 bp, Artificial sequence
  Synthetic oligonucleotide
cttaggcgccataggatcgcccggc

SEQ ID NO: 731598 - DNA, 25 bp, Artificial sequence
  Synthetic oligonucleotide
ccggcctcgcgcgttgacatcgcta

SEQ ID NO: 731599 - DNA, 25 bp, Artificial sequence
  Synthetic oligonucleotide
cttaggcgccattggatcgcccggc

SEQ ID NO: 731600 - DNA, 25 bp, Artificial sequence
  Synthetic oligonucleotide
agcccccccgcgtatcgggatgatg

SEQ ID NO: 731601 - DNA, 25 bp, Artificial sequence
  Synthetic oligonucleotide
gcctgccggagcgttacgcgtacct

SEQ ID NO: 731602 - DNA, 25 bp, Artificial sequence
  Synthetic oligonucleotide
aggtcgcgaccagggtacgagtggc

SEQ ID NO: 731603 - DNA, 25 bp, Artificial sequence
  Synthetic oligonucleotide
gcctgccggagccttacgcgtacct

SEQ ID NO: 731604 - DNA, 25 bp, Artificial sequence
  Synthetic oligonucleotide
gctcctgcgtcgcgctataggggtg

SEQ ID NO: 731605 - DNA, 25 bp, Artificial sequence
  Synthetic oligonucleotide
ggatgccgcgagactaagcgcccct

SEQ ID NO: 731606 - DNA, 25 bp, Artificial sequence
  Synthetic oligonucleotide
tgacccctagcgcaagccgtctgcc

SEQ ID NO: 731607 - DNA, 25 bp, Artificial sequence
  Synthetic oligonucleotide
tcgcccctctacgcgccgatgccta

SEQ ID NO: 731608 - DNA, 25 bp, Artificial sequence
  Synthetic oligonucleotide
tcgcccctctacccgccgatgccta

SEQ ID NO: 731609 - DNA, 25 bp, Artificial sequence
  Synthetic oligonucleotide
tgacccctagcggaagccgtctgcc

SEQ ID NO: 731610 - DNA, 25 bp, Artificial sequence
  Synthetic oligonucleotide
ggtgcgattcgaccgtcggggacac

SEQ ID NO: 731611 - DNA, 25 bp, Artificial sequence
  Synthetic oligonucleotide
gactcgatagccccgcgcgagctac

SEQ ID NO: 731612 - DNA, 25 bp, Artificial sequence
  Synthetic oligonucleotide
cggcaaaggcgccgtatcgcgcgat

SEQ ID NO: 731613 - DNA, 25 bp, Artificial sequence
  Synthetic oligonucleotide
cggcaaaggcgcggtatcgcgcgat

SEQ ID NO: 731614 - DNA, 25 bp, Artificial sequence
  Synthetic oligonucleotide
cacgtcgtacggatcgcggcagtgc

SEQ ID NO: 731615 - DNA, 25 bp, Artificial sequence
  Synthetic oligonucleotide
cacgtcgtacggttcgcggcagtgc

SEQ ID NO: 731616 - DNA, 25 bp, Artificial sequence
  Synthetic oligonucleotide
gggtaggcggtcggcactaggtcga

SEQ ID NO: 731617 - DNA, 25 bp, Artificial sequence
  Synthetic oligonucleotide
gggtaggcggtccgcactaggtcga

SEQ ID NO: 731618 - DNA, 25 bp, Artificial sequence
  Synthetic oligonucleotide
ccggcctcgcgccttgacatcgcta

SEQ ID NO: 731619 - DNA, 25 bp, Artificial sequence
  Synthetic oligonucleotide
ggatgccgcgagtctaagcgcccct

SEQ ID NO: 731620 - DNA, 25 bp, Artificial sequence
  Synthetic oligonucleotide
tgctccgggtacgtcgagcgcagag

SEQ ID NO: 731621 - DNA, 25 bp, Artificial sequence
  Synthetic oligonucleotide
tgctccgggtacctcgagcgcagag

SEQ ID NO: 731622 - DNA, 25 bp, Artificial sequence
  Synthetic oligonucleotide
cgctgtccgacgtacgactgccagc

SEQ ID NO: 731623 - DNA, 25 bp, Artificial sequence
  Synthetic oligonucleotide
cgctgtccgacgaacgactgccagc

SEQ ID NO: 731624 - DNA, 25 bp, Artificial sequence
  Synthetic oligonucleotide
tgcggttcgcgcgtacgactccgag

SEQ ID NO: 731625 - DNA, 25 bp, Artificial sequence
  Synthetic oligonucleotide
tgcggttcgcgcctacgactccgag

SEQ ID NO: 731626 - DNA, 25 bp, Artificial sequence
  Synthetic oligonucleotide
gtgcgagtcgtagcgcgaccttgcc

SEQ ID NO: 731627 - DNA, 25 bp, Artificial sequence
  Synthetic oligonucleotide
gtgcgagtcgtaccgcgaccttgcc

SEQ ID NO: 731628 - DNA, 25 bp, Artificial sequence
  Synthetic oligonucleotide
tcgcggcgtcgttcgtcggtctgga

SEQ ID NO: 731629 - DNA, 25 bp, Artificial sequence
  Synthetic oligonucleotide
tcgcggcgtcgtacgtcggtctgga

SEQ ID NO: 731630 - DNA, 25 bp, Artificial sequence
  Synthetic oligonucleotide
agcccccccgcgaatcgggatgatg

SEQ ID NO: 731631 - DNA, 25 bp, Artificial sequence
  Synthetic oligonucleotide
acagcgtggtctagcgcgaggtgcc

SEQ ID NO: 731632 - DNA, 25 bp, Artificial sequence
  Synthetic oligonucleotide
cgcagatacggccggtccgttcgac

SEQ ID NO: 731633 - DNA, 25 bp, Artificial sequence
  Synthetic oligonucleotide
tgcgccttaccgggtcggtgttgcc

SEQ ID NO: 731634 - DNA, 25 bp, Artificial sequence
  Synthetic oligonucleotide
gagcccgcgcgttataacgcccgga

SEQ ID NO: 731635 - DNA, 25 bp, Artificial sequence
  Synthetic oligonucleotide
gagcccgcgcgtaataacgcccgga

SEQ ID NO: 731636 - DNA, 25 bp, Artificial sequence
  Synthetic oligonucleotide
gatgcccgcaattccccgcgagctg

SEQ ID NO: 731637 - DNA, 25 bp, Artificial sequence
  Synthetic oligonucleotide
gatgcccgcaataccccgcgagctg

SEQ ID NO: 731638 - DNA, 25 bp, Artificial sequence
  Synthetic oligonucleotide
cgcagatacggcgggtccgttcgac

SEQ ID NO: 731639 - DNA, 25 bp, Artificial sequence
  Synthetic oligonucleotide
ggtgcgattcgagcgtcggggacac

SEQ ID NO: 731640 - DNA, 25 bp, Artificial sequence
  Synthetic oligonucleotide
agccgctacggtgccgacgtaggca

SEQ ID NO: 731641 - DNA, 25 bp, Artificial sequence
  Synthetic oligonucleotide
agccgctacggtcccgacgtaggca

SEQ ID NO: 731642 - DNA, 25 bp, Artificial sequence
  Synthetic oligonucleotide
cggtcctagcgtagaccgcatgcgc

SEQ ID NO: 731643 - DNA, 25 bp, Artificial sequence
  Synthetic oligonucleotide
acttcgcgaacgccctacggcacgg

SEQ ID NO: 731644 - DNA, 25 bp, Artificial sequence
  Synthetic oligonucleotide
cggtcctagcgttgaccgcatgcgc

SEQ ID NO: 731645 - DNA, 25 bp, Artificial sequence
  Synthetic oligonucleotide
acagcgtggtcttgcgcgaggtgcc

SEQ ID NO: 731646 - DNA, 25 bp, Artificial sequence
  Synthetic oligonucleotide
gcggcaacgggtcgaccgaagcgta

SEQ ID NO: 731647 - DNA, 25 bp, Artificial sequence
  Synthetic oligonucleotide
gcggcaacgggtggaccgaagcgta

SEQ ID NO: 731648 - DNA, 25 bp, Artificial sequence
  Synthetic oligonucleotide
gcgagaacgcggtaacgcccgtgac

SEQ ID NO: 731649 - DNA, 25 bp, Artificial sequence
  Synthetic oligonucleotide
gcgagaacgcggaaacgcccgtgac

SEQ ID NO: 731650 - DNA, 25 bp, Artificial sequence
  Synthetic oligonucleotide
tcaggggcgtcccacgtcttcgcgt

SEQ ID NO: 731651 - DNA, 25 bp, Artificial sequence
  Synthetic oligonucleotide
gaatgccgtacgacgcgccccctgt

SEQ ID NO: 731652 - DNA, 25 bp, Artificial sequence
  Synthetic oligonucleotide
tacgcgacgaccccgtcgtgacctg

SEQ ID NO: 731653 - DNA, 25 bp, Artificial sequence
  Synthetic oligonucleotide
tcaggggcgtccgacgtcttcgcgt

SEQ ID NO: 731654 - DNA, 25 bp, Artificial sequence
  Synthetic oligonucleotide
tccagccgctacccgcagtccgaga

SEQ ID NO: 731655 - DNA, 25 bp, Artificial sequence
  Synthetic oligonucleotide
acttcgcgaacggcctacggcacgg

SEQ ID NO: 731656 - DNA, 25 bp, Artificial sequence
  Synthetic oligonucleotide
aatgcccctaacggccgactgcgcc

SEQ ID NO: 731657 - DNA, 25 bp, Artificial sequence
  Synthetic oligonucleotide
cccctagccgtggtacgcgctcaag

SEQ ID NO: 731658 - DNA, 25 bp, Artificial sequence
  Synthetic oligonucleotide
ccgtccctgttaggtcgcgacaggc

SEQ ID NO: 731659 - DNA, 25 bp, Artificial sequence
  Synthetic oligonucleotide
ccgtccctgttacgtcgcgacaggc

SEQ ID NO: 731660 - DNA, 25 bp, Artificial sequence
  Synthetic oligonucleotide
cgcatcgtcgcgcagcgaagccaac

SEQ ID NO: 731661 - DNA, 25 bp, Artificial sequence
  Synthetic oligonucleotide
cgcatcgtcgcggagcgaagccaac

SEQ ID NO: 731662 - DNA, 25 bp, Artificial sequence
  Synthetic oligonucleotide
aaccggagccgaccgcgtaagccca

SEQ ID NO: 731663 - DNA, 25 bp, Artificial sequence
  Synthetic oligonucleotide
aaccggagccgagcgcgtaagccca

SEQ ID NO: 731664 - DNA, 25 bp, Artificial sequence
  Synthetic oligonucleotide
tgccggcccaacgtacgcgtggcat

SEQ ID NO: 731665 - DNA, 25 bp, Artificial sequence
  Synthetic oligonucleotide
tgccggcccaacctacgcgtggcat

SEQ ID NO: 731666 - DNA, 25 bp, Artificial sequence
  Synthetic oligonucleotide
gcaacatgcgtcctgcgacctgcgg

SEQ ID NO: 731667 - DNA, 25 bp, Artificial sequence
  Synthetic oligonucleotide
tgcgccttaccgcgtcggtgttgcc

SEQ ID NO: 731668 - DNA, 25 bp, Artificial sequence
  Synthetic oligonucleotide
aatgcccctaaccgccgactgcgcc

SEQ ID NO: 731669 - DNA, 25 bp, Artificial sequence
  Synthetic oligonucleotide
cccctagccgtgctacgcgctcaag

SEQ ID NO: 731670 - DNA, 25 bp, Artificial sequence
  Synthetic oligonucleotide
tacacggtccgatcgcggaacgggc

SEQ ID NO: 731671 - DNA, 25 bp, Artificial sequence
  Synthetic oligonucleotide
tacacggtccgaacgcggaacgggc

SEQ ID NO: 731672 - DNA, 25 bp, Artificial sequence
  Synthetic oligonucleotide
tgcgtcggtcgcggggtatgtggtc

SEQ ID NO: 731673 - DNA, 25 bp, Artificial sequence
  Synthetic oligonucleotide
tgcgtcggtcgccgggtatgtggtc

SEQ ID NO: 731674 - DNA, 25 bp, Artificial sequence
  Synthetic oligonucleotide
tgcccaacggtcgatagcgccacgg

SEQ ID NO: 731675 - DNA, 25 bp, Artificial sequence
  Synthetic oligonucleotide
tgcccaacggtccatagcgccacgg

SEQ ID NO: 731676 - DNA, 25 bp, Artificial sequence
  Synthetic oligonucleotide
acttcccgcgcgttagacgcgccca

SEQ ID NO: 731677 - DNA, 25 bp, Artificial sequence
  Synthetic oligonucleotide
acttcccgcgcgatagacgcgccca

SEQ ID NO: 731678 - DNA, 25 bp, Artificial sequence
  Synthetic oligonucleotide
tgaaccagcgcgacgtaccgcaggc

SEQ ID NO: 731679 - DNA, 25 bp, Artificial sequence
  Synthetic oligonucleotide
tgaaccagcgcgtcgtaccgcaggc

SEQ ID NO: 731680 - DNA, 25 bp, Artificial sequence
  Synthetic oligonucleotide
gcaacatgcgtcgtgcgacctgcgg

SEQ ID NO: 731681 - DNA, 25 bp, Artificial sequence
  Synthetic oligonucleotide
ttccgcgtagggaacgcgacctgcc

SEQ ID NO: 731682 - DNA, 25 bp, Artificial sequence
  Synthetic oligonucleotide
tccctagacgtatcgcccgcccgtc

SEQ ID NO: 731683 - DNA, 25 bp, Artificial sequence
  Synthetic oligonucleotide
tacgcgacgaccgcgtcgtgacctg

SEQ ID NO: 731684 - DNA, 25 bp, Artificial sequence
  Synthetic oligonucleotide
gcgtgtctaacgtcgaccagggggg

SEQ ID NO: 731685 - DNA, 25 bp, Artificial sequence
  Synthetic oligonucleotide
cgccatagcgcgaagcacgctgcag

SEQ ID NO: 731686 - DNA, 25 bp, Artificial sequence
  Synthetic oligonucleotide
cgccatagcgcgtagcacgctgcag

SEQ ID NO: 731687 - DNA, 25 bp, Artificial sequence
  Synthetic oligonucleotide
gcgtaccggtccctacgaaggtggc

SEQ ID NO: 731688 - DNA, 25 bp, Artificial sequence
  Synthetic oligonucleotide
gcgtaccggtccgtacgaaggtggc

SEQ ID NO: 731689 - DNA, 25 bp, Artificial sequence
  Synthetic oligonucleotide
ctcgcacgcgataacggcggcatgg

SEQ ID NO: 731690 - DNA, 25 bp, Artificial sequence
  Synthetic oligonucleotide
ctcgcacgcgattacggcggcatgg

SEQ ID NO: 731691 - DNA, 25 bp, Artificial sequence
  Synthetic oligonucleotide
accggccctcgtccgcgtacacttg

SEQ ID NO: 731692 - DNA, 25 bp, Artificial sequence
  Synthetic oligonucleotide
ccccttcgcctagacgcgatctcgc

SEQ ID NO: 731693 - DNA, 25 bp, Artificial sequence
  Synthetic oligonucleotide
ttccgcgtagggtacgcgacctgcc

SEQ ID NO: 731694 - DNA, 25 bp, Artificial sequence
  Synthetic oligonucleotide
ccgtgcccttacgcgaacgccagtg

SEQ ID NO: 731695 - DNA, 25 bp, Artificial sequence
  Synthetic oligonucleotide
ccaggccgcgcgatctagtcgtctg

SEQ ID NO: 731696 - DNA, 25 bp, Artificial sequence
  Synthetic oligonucleotide
ccaggccgcgcgttctagtcgtctg

SEQ ID NO: 731697 - DNA, 25 bp, Artificial sequence
  Synthetic oligonucleotide
agctcgactagtggctccgcctgcg

SEQ ID NO: 731698 - DNA, 25 bp, Artificial sequence
  Synthetic oligonucleotide
agctcgactagtcgctccgcctgcg

SEQ ID NO: 731699 - DNA, 25 bp, Artificial sequence
  Synthetic oligonucleotide
ccccccgaccgacacgctaaagtgc

SEQ ID NO: 731700 - DNA, 25 bp, Artificial sequence
  Synthetic oligonucleotide
ccccccgaccgagacgctaaagtgc

SEQ ID NO: 731701 - DNA, 25 bp, Artificial sequence
  Synthetic oligonucleotide
gcgcgcgcggtcaaaatcgtacggg

SEQ ID NO: 731702 - DNA, 25 bp, Artificial sequence
  Synthetic oligonucleotide
gaccacaacgcgactagcgcgggga

SEQ ID NO: 731703 - DNA, 25 bp, Artificial sequence
  Synthetic oligonucleotide
tggtagcgtgtacgaccggagggcg

SEQ ID NO: 731704 - DNA, 25 bp, Artificial sequence
  Synthetic oligonucleotide
gcgtgtctaacgacgaccagggggg

SEQ ID NO: 731705 - DNA, 25 bp, Artificial sequence
  Synthetic oligonucleotide
accggccctcgtgcgcgtacacttg

SEQ ID NO: 731706 - DNA, 25 bp, Artificial sequence
  Synthetic oligonucleotide
catgtactacgcgggacgtccggcg

SEQ ID NO: 731707 - DNA, 25 bp, Artificial sequence
  Synthetic oligonucleotide
gaccacaacgcgtctagcgcgggga

SEQ ID NO: 731708 - DNA, 25 bp, Artificial sequence
  Synthetic oligonucleotide
tccagccgctacgcgcagtccgaga

SEQ ID NO: 731709 - DNA, 25 bp, Artificial sequence
  Synthetic oligonucleotide
cacccttacgcgtgcgacctgtggg

SEQ ID NO: 731710 - DNA, 25 bp, Artificial sequence
  Synthetic oligonucleotide
cacccttacgcgagcgacctgtggg

SEQ ID NO: 731711 - DNA, 25 bp, Artificial sequence
  Synthetic oligonucleotide
tcacggcgcctaggtaccgggacct

SEQ ID NO: 731712 - DNA, 25 bp, Artificial sequence
  Synthetic oligonucleotide
tcacggcgcctacgtaccgggacct

SEQ ID NO: 731713 - DNA, 25 bp, Artificial sequence
  Synthetic oligonucleotide
ttggcgcccgcgaaagtcgggttcg

SEQ ID NO: 731714 - DNA, 25 bp, Artificial sequence
  Synthetic oligonucleotide
ttggcgcccgcgtaagtcgggttcg

SEQ ID NO: 731715 - DNA, 25 bp, Artificial sequence
  Synthetic oligonucleotide
gcgcagaacgtcggcgcaagacgct

SEQ ID NO: 731716 - DNA, 25 bp, Artificial sequence
  Synthetic oligonucleotide
gcgcagaacgtccgcgcaagacgct

SEQ ID NO: 731717 - DNA, 25 bp, Artificial sequence
  Synthetic oligonucleotide
ccccttcgcctacacgcgatctcgc

SEQ ID NO: 731718 - DNA, 25 bp, Artificial sequence
  Synthetic oligonucleotide
gtcgcctcgcgccctaaacaaggcc

SEQ ID NO: 731719 - DNA, 25 bp, Artificial sequence
  Synthetic oligonucleotide
tccctagacgtaacgcccgcccgtc

SEQ ID NO: 731720 - DNA, 25 bp, Artificial sequence
  Synthetic oligonucleotide
catgtactacgccggacgtccggcg

SEQ ID NO: 731721 - DNA, 25 bp, Artificial sequence
  Synthetic oligonucleotide
ggcgttctcgacgggtcgatacgcg

SEQ ID NO: 731722 - DNA, 25 bp, Artificial sequence
  Synthetic oligonucleotide
ggcgttctcgaccggtcgatacgcg

SEQ ID NO: 731723 - DNA, 25 bp, Artificial sequence
  Synthetic oligonucleotide
gcggctccgcgttctaggtccgaca

SEQ ID NO: 731724 - DNA, 25 bp, Artificial sequence
  Synthetic oligonucleotide
gcggctccgcgtactaggtccgaca

SEQ ID NO: 731725 - DNA, 25 bp, Artificial sequence
  Synthetic oligonucleotide
gtctagaccggtgtaccgctggggg

SEQ ID NO: 731726 - DNA, 25 bp, Artificial sequence
  Synthetic oligonucleotide
gtctagaccggtctaccgctggggg

SEQ ID NO: 731727 - DNA, 25 bp, Artificial sequence
  Synthetic oligonucleotide
ccgcagcgcgcatcggtcagctcta

SEQ ID NO: 731728 - DNA, 25 bp, Artificial sequence
  Synthetic oligonucleotide
ccgcagcgcgcaacggtcagctcta

SEQ ID NO: 731729 - DNA, 25 bp, Artificial sequence
  Synthetic oligonucleotide
ccgtgcccttacccgaacgccagtg

SEQ ID NO: 731730 - DNA, 25 bp, Artificial sequence
  Synthetic oligonucleotide
gtcgcctcgcgcgctaaacaaggcc

SEQ ID NO: 731731 - DNA, 25 bp, Artificial sequence
  Synthetic oligonucleotide
gtactgcacgatcgaccgggaggcc

SEQ ID NO: 731732 - DNA, 25 bp, Artificial sequence
  Synthetic oligonucleotide
tggtagcgtgtaggaccggagggcg

SEQ ID NO: 731733 - DNA, 25 bp, Artificial sequence
  Synthetic oligonucleotide
tggtagttgcgtaacgcggcccgcg

SEQ ID NO: 731734 - DNA, 25 bp, Artificial sequence
  Synthetic oligonucleotide
tggtagttgcgttacgcggcccgcg

SEQ ID NO: 731735 - DNA, 25 bp, Artificial sequence
  Synthetic oligonucleotide
ggcgattgtcgcccgtacatcgcgc

SEQ ID NO: 731736 - DNA, 25 bp, Artificial sequence
  Synthetic oligonucleotide
ggcgattgtcgcgcgtacatcgcgc

SEQ ID NO: 731737 - DNA, 25 bp, Artificial sequence
  Synthetic oligonucleotide
acgcggcgacggaattcgcggtcac

SEQ ID NO: 731738 - DNA, 25 bp, Artificial sequence
  Synthetic oligonucleotide
acgcggcgacggtattcgcggtcac

SEQ ID NO: 731739 - DNA, 25 bp, Artificial sequence
  Synthetic oligonucleotide
ccgcgcgtaggcggtcgctagtaac

SEQ ID NO: 731740 - DNA, 25 bp, Artificial sequence
  Synthetic oligonucleotide
ccgcgcgtaggccgtcgctagtaac

SEQ ID NO: 731741 - DNA, 25 bp, Artificial sequence
  Synthetic oligonucleotide
gggccaccgctaggatgcgttggtc

SEQ ID NO: 731742 - DNA, 25 bp, Artificial sequence
  Synthetic oligonucleotide
ccggagcgccctgtcgaaccagtag

SEQ ID NO: 731743 - DNA, 25 bp, Artificial sequence
  Synthetic oligonucleotide
gtactgcacgatggaccgggaggcc

SEQ ID NO: 731744 - DNA, 25 bp, Artificial sequence
  Synthetic oligonucleotide
gagtgtgcctacacgcgtcgcacgc

SEQ ID NO: 731745 - DNA, 25 bp, Artificial sequence
  Synthetic oligonucleotide
ggcagttaggactcgcgcgttcggc

SEQ ID NO: 731746 - DNA, 25 bp, Artificial sequence
  Synthetic oligonucleotide
ggcagttaggacacgcgcgttcggc

SEQ ID NO: 731747 - DNA, 25 bp, Artificial sequence
  Synthetic oligonucleotide
tgcgccctacgagcgttcgccgact

SEQ ID NO: 731748 - DNA, 25 bp, Artificial sequence
  Synthetic oligonucleotide
tgcgccctacgaccgttcgccgact

SEQ ID NO: 731749 - DNA, 25 bp, Artificial sequence
  Synthetic oligonucleotide
tctgcgcgcgcgtattcggttgcgg

SEQ ID NO: 731750 - DNA, 25 bp, Artificial sequence
  Synthetic oligonucleotide
tctgcgcgcgcgaattcggttgcgg

SEQ ID NO: 731751 - DNA, 25 bp, Artificial sequence
  Synthetic oligonucleotide
agcccgggcgtttcgggctagagac

SEQ ID NO: 731752 - DNA, 25 bp, Artificial sequence
  Synthetic oligonucleotide
agcccgggcgttacgggctagagac

SEQ ID NO: 731753 - DNA, 25 bp, Artificial sequence
  Synthetic oligonucleotide
cggtaaggtaatcgcgcggcccgca

SEQ ID NO: 731754 - DNA, 25 bp, Artificial sequence
  Synthetic oligonucleotide
cggtaaggtaatggcgcggcccgca

SEQ ID NO: 731755 - DNA, 25 bp, Artificial sequence
  Synthetic oligonucleotide
gggccaccgctacgatgcgttggtc

SEQ ID NO: 731756 - DNA, 25 bp, Artificial sequence
  Synthetic oligonucleotide
aggtgccgcgattaggacgtccgcg

SEQ ID NO: 731757 - DNA, 25 bp, Artificial sequence
  Synthetic oligonucleotide
atcgccgttacgtcggtccgcacgc

SEQ ID NO: 731758 - DNA, 25 bp, Artificial sequence
  Synthetic oligonucleotide
atcgccgttacgacggtccgcacgc

SEQ ID NO: 731759 - DNA, 25 bp, Artificial sequence
  Synthetic oligonucleotide
ggttagacgtacgacgcgggaccgc

SEQ ID NO: 731760 - DNA, 25 bp, Artificial sequence
  Synthetic oligonucleotide
ggttagacgtaccacgcgggaccgc

SEQ ID NO: 731761 - DNA, 25 bp, Artificial sequence
  Synthetic oligonucleotide
ctctcgacgcaaggacggggaggac

SEQ ID NO: 731762 - DNA, 25 bp, Artificial sequence
  Synthetic oligonucleotide
ctctcgacgcaacgacggggaggac

SEQ ID NO: 731763 - DNA, 25 bp, Artificial sequence
  Synthetic oligonucleotide
tcggtgacggatcgcgaacgacccg

SEQ ID NO: 731764 - DNA, 25 bp, Artificial sequence
  Synthetic oligonucleotide
tcggtgacggatggcgaacgacccg

SEQ ID NO: 731765 - DNA, 25 bp, Artificial sequence
  Synthetic oligonucleotide
gtctgcacgtaaccgctgctccggg

SEQ ID NO: 731766 - DNA, 25 bp, Artificial sequence
  Synthetic oligonucleotide
gtctgcacgtaagcgctgctccggg

SEQ ID NO: 731767 - DNA, 25 bp, Artificial sequence
  Synthetic oligonucleotide
ccggagcgccctctcgaaccagtag

SEQ ID NO: 731768 - DNA, 25 bp, Artificial sequence
  Synthetic oligonucleotide
ttggccttagcggacgcgtgtcgcc

SEQ ID NO: 731769 - DNA, 25 bp, Artificial sequence
  Synthetic oligonucleotide
gaatgccgtacgtcgcgccccctgt

SEQ ID NO: 731770 - DNA, 25 bp, Artificial sequence
  Synthetic oligonucleotide
aggtgccgcgataaggacgtccgcg

SEQ ID NO: 731771 - DNA, 25 bp, Artificial sequence
  Synthetic oligonucleotide
cgcgatacccgccgtatgaccccga

SEQ ID NO: 731772 - DNA, 25 bp, Artificial sequence
  Synthetic oligonucleotide
cgcgatacccgcggtatgaccccga

SEQ ID NO: 731773 - DNA, 25 bp, Artificial sequence
  Synthetic oligonucleotide
tctagctagtagggccgcggtgccg

SEQ ID NO: 731774 - DNA, 25 bp, Artificial sequence
  Synthetic oligonucleotide
tctagctagtagcgccgcggtgccg

SEQ ID NO: 731775 - DNA, 25 bp, Artificial sequence
  Synthetic oligonucleotide
tggctcccgccggataacgcgtcca

SEQ ID NO: 731776 - DNA, 25 bp, Artificial sequence
  Synthetic oligonucleotide
tggctcccgccgcataacgcgtcca

SEQ ID NO: 731777 - DNA, 25 bp, Artificial sequence
  Synthetic oligonucleotide
ccctagcggtgccatacgggtcacc

SEQ ID NO: 731778 - DNA, 25 bp, Artificial sequence
  Synthetic oligonucleotide
ccctagcggtgcgatacgggtcacc

SEQ ID NO: 731779 - DNA, 25 bp, Artificial sequence
  Synthetic oligonucleotide
gagtgtgcctactcgcgtcgcacgc

SEQ ID NO: 731780 - DNA, 25 bp, Artificial sequence
  Synthetic oligonucleotide
ttggccttagcgcacgcgtgtcgcc

SEQ ID NO: 731781 - DNA, 25 bp, Artificial sequence
  Synthetic oligonucleotide
ccacgtcggacgaaatcgccccctc

SEQ ID NO: 731782 - DNA, 25 bp, Artificial sequence
  Synthetic oligonucleotide
cagggctccctacgcgtcggcactt

SEQ ID NO: 731783 - DNA, 25 bp, Artificial sequence
  Synthetic oligonucleotide
tagggggtagtcccggaccgtggct

SEQ ID NO: 731784 - DNA, 25 bp, Artificial sequence
  Synthetic oligonucleotide
tagggggtagtcgcggaccgtggct

SEQ ID NO: 731785 - DNA, 25 bp, Artificial sequence
  Synthetic oligonucleotide
cggactgcgcggaatagtcacccgg

SEQ ID NO: 731786 - DNA, 25 bp, Artificial sequence
  Synthetic oligonucleotide
cggactgcgcggtatagtcacccgg

SEQ ID NO: 731787 - DNA, 25 bp, Artificial sequence
  Synthetic oligonucleotide
caccctcgtccgggaatggcctgac

SEQ ID NO: 731788 - DNA, 25 bp, Artificial sequence
  Synthetic oligonucleotide
caccctcgtccgcgaatggcctgac

SEQ ID NO: 731789 - DNA, 25 bp, Artificial sequence
  Synthetic oligonucleotide
cggccactacggacgttcgcccaca

SEQ ID NO: 731790 - DNA, 25 bp, Artificial sequence
  Synthetic oligonucleotide
cggccactacggtcgttcgcccaca

SEQ ID NO: 731791 - DNA, 25 bp, Artificial sequence
  Synthetic oligonucleotide
tgggggtagtacgcgcgacgtctcc

SEQ ID NO: 731792 - DNA, 25 bp, Artificial sequence
  Synthetic oligonucleotide
gcaccccttgcgttagcgcggactc

SEQ ID NO: 731793 - DNA, 25 bp, Artificial sequence
  Synthetic oligonucleotide
ccacgtcggacgtaatcgccccctc

SEQ ID NO: 731794 - DNA, 25 bp, Artificial sequence
  Synthetic oligonucleotide
gtcacgtcccgttagcgcgccatcg

SEQ ID NO: 731795 - DNA, 25 bp, Artificial sequence
  Synthetic oligonucleotide
gccaagcatgacgagcgcgaggcag

SEQ ID NO: 731796 - DNA, 25 bp, Artificial sequence
  Synthetic oligonucleotide
gccaagcatgaccagcgcgaggcag

SEQ ID NO: 731797 - DNA, 25 bp, Artificial sequence
  Synthetic oligonucleotide
cgggtacgtcgctcgagtaggcctg

SEQ ID NO: 731798 - DNA, 25 bp, Artificial sequence
  Synthetic oligonucleotide
cgggtacgtcgcacgagtaggcctg

SEQ ID NO: 731799 - DNA, 25 bp, Artificial sequence
  Synthetic oligonucleotide
cggccccctaccccgcgaatgcatt

SEQ ID NO: 731800 - DNA, 25 bp, Artificial sequence
  Synthetic oligonucleotide
cggccccctaccgcgcgaatgcatt

SEQ ID NO: 731801 - DNA, 25 bp, Artificial sequence
  Synthetic oligonucleotide
ccatgcggcgtacgatcgagtcgcc

SEQ ID NO: 731802 - DNA, 25 bp, Artificial sequence
  Synthetic oligonucleotide
ccatgcggcgtaggatcgagtcgcc

SEQ ID NO: 731803 - DNA, 25 bp, Artificial sequence
  Synthetic oligonucleotide
ggcgtcgcgctagcgtatgagtcgg

SEQ ID NO: 731804 - DNA, 25 bp, Artificial sequence
  Synthetic oligonucleotide
ggcgtcgcgctaccgtatgagtcgg

SEQ ID NO: 731805 - DNA, 25 bp, Artificial sequence
  Synthetic oligonucleotide
tgggggtagtacccgcgacgtctcc

SEQ ID NO: 731806 - DNA, 25 bp, Artificial sequence
  Synthetic oligonucleotide
ctagcctacgcgcgcttaccacggc

SEQ ID NO: 731807 - DNA, 25 bp, Artificial sequence
  Synthetic oligonucleotide
ctcccgacgctaaaccggccatggg

SEQ ID NO: 731808 - DNA, 25 bp, Artificial sequence
  Synthetic oligonucleotide
ctcccgacgctataccggccatggg

SEQ ID NO: 731809 - DNA, 25 bp, Artificial sequence
  Synthetic oligonucleotide
caaacggtcgtcaacgcggctgcgg

SEQ ID NO: 731810 - DNA, 25 bp, Artificial sequence
  Synthetic oligonucleotide
caaacggtcgtctacgcggctgcgg

SEQ ID NO: 731811 - DNA, 25 bp, Artificial sequence
  Synthetic oligonucleotide
gctccgcagccgatatacgggaggg

SEQ ID NO: 731812 - DNA, 25 bp, Artificial sequence
  Synthetic oligonucleotide
gctccgcagccgttatacgggaggg

SEQ ID NO: 731813 - DNA, 25 bp, Artificial sequence
  Synthetic oligonucleotide
cggctggccgcgaacgctaaaggga

SEQ ID NO: 731814 - DNA, 25 bp, Artificial sequence
  Synthetic oligonucleotide
cggctggccgcgtacgctaaaggga

SEQ ID NO: 731815 - DNA, 25 bp, Artificial sequence
  Synthetic oligonucleotide
gcatgataacgaggcaccgccgccc

SEQ ID NO: 731816 - DNA, 25 bp, Artificial sequence
  Synthetic oligonucleotide
gcatgataacgacgcaccgccgccc

SEQ ID NO: 731817 - DNA, 25 bp, Artificial sequence
  Synthetic oligonucleotide
gcaccccttgcgatagcgcggactc

SEQ ID NO: 731818 - DNA, 25 bp, Artificial sequence
  Synthetic oligonucleotide
gagcagggaacccacgcgtaccagc

SEQ ID NO: 731819 - DNA, 25 bp, Artificial sequence
  Synthetic oligonucleotide
ccgccctaacgattgcgcgacgcca

SEQ ID NO: 731820 - DNA, 25 bp, Artificial sequence
  Synthetic oligonucleotide
ctagcctacgcgggcttaccacggc

SEQ ID NO: 731821 - DNA, 25 bp, Artificial sequence
  Synthetic oligonucleotide
tgagtaccgagtacgcgctcgcccc

SEQ ID NO: 731822 - DNA, 25 bp, Artificial sequence
  Synthetic oligonucleotide
tgagtaccgagttcgcgctcgcccc

SEQ ID NO: 731823 - DNA, 25 bp, Artificial sequence
  Synthetic oligonucleotide
ccgttggcgcgtggacgttctcagg

SEQ ID NO: 731824 - DNA, 25 bp, Artificial sequence
  Synthetic oligonucleotide
ccgttggcgcgtcgacgttctcagg

SEQ ID NO: 731825 - DNA, 25 bp, Artificial sequence
  Synthetic oligonucleotide
tcctgcatgttcggcgcgttgcggg

SEQ ID NO: 731826 - DNA, 25 bp, Artificial sequence
  Synthetic oligonucleotide
tcctgcatgttccgcgcgttgcggg

SEQ ID NO: 731827 - DNA, 25 bp, Artificial sequence
  Synthetic oligonucleotide
gccgagctggaccatcggcttggtc

SEQ ID NO: 731828 - DNA, 25 bp, Artificial sequence
  Synthetic oligonucleotide
gccgagctggacgatcggcttggtc

SEQ ID NO: 731829 - DNA, 25 bp, Artificial sequence
  Synthetic oligonucleotide
gtcacgtcccgtaagcgcgccatcg

SEQ ID NO: 731830 - DNA, 25 bp, Artificial sequence
  Synthetic oligonucleotide
gagcagggaaccgacgcgtaccagc

SEQ ID NO: 731831 - DNA, 25 bp, Artificial sequence
  Synthetic oligonucleotide
cagtgacgcgacggcactacgcagg

SEQ ID NO: 731832 - DNA, 25 bp, Artificial sequence
  Synthetic oligonucleotide
gtatggtacctccaccgcgggagcg

SEQ ID NO: 731833 - DNA, 25 bp, Artificial sequence
  Synthetic oligonucleotide
tgctgggcgcgtcaagggactacgc

SEQ ID NO: 731834 - DNA, 25 bp, Artificial sequence
  Synthetic oligonucleotide
tgctgggcgcgtgaagggactacgc

SEQ ID NO: 731835 - DNA, 25 bp, Artificial sequence
  Synthetic oligonucleotide
gctcaatcgacgggactagcgcggg

SEQ ID NO: 731836 - DNA, 25 bp, Artificial sequence
  Synthetic oligonucleotide
gctcaatcgacgcgactagcgcggg

SEQ ID NO: 731837 - DNA, 25 bp, Artificial sequence
  Synthetic oligonucleotide
cgcccgtccgattcgtccgaatgcc

SEQ ID NO: 731838 - DNA, 25 bp, Artificial sequence
  Synthetic oligonucleotide
cgcccgtccgatacgtccgaatgcc

SEQ ID NO: 731839 - DNA, 25 bp, Artificial sequence
  Synthetic oligonucleotide
cctggccgtatcctgtcgcgcggaa

SEQ ID NO: 731840 - DNA, 25 bp, Artificial sequence
  Synthetic oligonucleotide
cctggccgtatcgtgtcgcgcggaa

SEQ ID NO: 731841 - DNA, 25 bp, Artificial sequence
  Synthetic oligonucleotide
agcttgcggacgtagtcgcaccgcg

SEQ ID NO: 731842 - DNA, 25 bp, Artificial sequence
  Synthetic oligonucleotide
ggcgccatagcggtcgcgtacctag

SEQ ID NO: 731843 - DNA, 25 bp, Artificial sequence
  Synthetic oligonucleotide
cagtgacgcgaccgcactacgcagg

SEQ ID NO: 731844 - DNA, 25 bp, Artificial sequence
  Synthetic oligonucleotide
ctaccacgcgccgatctaacgcggg

SEQ ID NO: 731845 - DNA, 25 bp, Artificial sequence
  Synthetic oligonucleotide
atgctcgcctattccgcggacccgg

SEQ ID NO: 731846 - DNA, 25 bp, Artificial sequence
  Synthetic oligonucleotide
atgctcgcctataccgcggacccgg

SEQ ID NO: 731847 - DNA, 25 bp, Artificial sequence
  Synthetic oligonucleotide
cggcctactgcgcggattagcaggg

SEQ ID NO: 731848 - DNA, 25 bp, Artificial sequence
  Synthetic oligonucleotide
cggcctactgcggggattagcaggg

SEQ ID NO: 731849 - DNA, 25 bp, Artificial sequence
  Synthetic oligonucleotide
ggtgtgcgataccgcgcgttggagg

SEQ ID NO: 731850 - DNA, 25 bp, Artificial sequence
  Synthetic oligonucleotide
ggtgtgcgatacggcgcgttggagg

SEQ ID NO: 731851 - DNA, 25 bp, Artificial sequence
  Synthetic oligonucleotide
cccggcgcctcgtacgcgagtctaa

SEQ ID NO: 731852 - DNA, 25 bp, Artificial sequence
  Synthetic oligonucleotide
tcggcctagtcccgcggatgatggc

SEQ ID NO: 731853 - DNA, 25 bp, Artificial sequence
  Synthetic oligonucleotide
gcgcgcgcggtctaaatcgtacggg

SEQ ID NO: 731854 - DNA, 25 bp, Artificial sequence
  Synthetic oligonucleotide
ggtccgaccgttactcgcgggatcg

SEQ ID NO: 731855 - DNA, 25 bp, Artificial sequence
  Synthetic oligonucleotide
agcttgcggacgaagtcgcaccgcg

SEQ ID NO: 731856 - DNA, 25 bp, Artificial sequence
  Synthetic oligonucleotide
ctcctcgttatactcgcggcgcggg

SEQ ID NO: 731857 - DNA, 25 bp, Artificial sequence
  Synthetic oligonucleotide
cccggcgcctcgaacgcgagtctaa

SEQ ID NO: 731858 - DNA, 25 bp, Artificial sequence
  Synthetic oligonucleotide
ccgccctaacgaatgcgcgacgcca

SEQ ID NO: 731859 - DNA, 25 bp, Artificial sequence
  Synthetic oligonucleotide
tcggcctagtccggcggatgatggc

SEQ ID NO: 731860 - DNA, 25 bp, Artificial sequence
  Synthetic oligonucleotide
gttatgcgtcccaatcgcgcggccg

SEQ ID NO: 731861 - DNA, 25 bp, Artificial sequence
  Synthetic oligonucleotide
gttatgcgtccctatcgcgcggccg

SEQ ID NO: 731862 - DNA, 25 bp, Artificial sequence
  Synthetic oligonucleotide
ccgatccgtggacgctacccatcgc

SEQ ID NO: 731863 - DNA, 25 bp, Artificial sequence
  Synthetic oligonucleotide
ccgatccgtggaggctacccatcgc

SEQ ID NO: 731864 - DNA, 25 bp, Artificial sequence
  Synthetic oligonucleotide
acggtgacgtccgaaggcgcatgcc

SEQ ID NO: 731865 - DNA, 25 bp, Artificial sequence
  Synthetic oligonucleotide
acggtgacgtcccaaggcgcatgcc

SEQ ID NO: 731866 - DNA, 25 bp, Artificial sequence
  Synthetic oligonucleotide
agatcccgcgacccgtacacagcgg

SEQ ID NO: 731867 - DNA, 25 bp, Artificial sequence
  Synthetic oligonucleotide
gtatggtacctcgaccgcgggagcg

SEQ ID NO: 731868 - DNA, 25 bp, Artificial sequence
  Synthetic oligonucleotide
ctcctcgttatagtcgcggcgcggg

SEQ ID NO: 731869 - DNA, 25 bp, Artificial sequence
  Synthetic oligonucleotide
ctaccacgcgcccatctaacgcggg

SEQ ID NO: 731870 - DNA, 25 bp, Artificial sequence
  Synthetic oligonucleotide
ctaagccttacggggccgagcaccc

SEQ ID NO: 731871 - DNA, 25 bp, Artificial sequence
  Synthetic oligonucleotide
ctaagccttacgcggccgagcaccc

SEQ ID NO: 731872 - DNA, 25 bp, Artificial sequence
  Synthetic oligonucleotide
ggccccagcgcgcgattagctttgg

SEQ ID NO: 731873 - DNA, 25 bp, Artificial sequence
  Synthetic oligonucleotide
ggccccagcgcgggattagctttgg

SEQ ID NO: 731874 - DNA, 25 bp, Artificial sequence
  Synthetic oligonucleotide
gctagaaccgcgcagcgtacaccgc

SEQ ID NO: 731875 - DNA, 25 bp, Artificial sequence
  Synthetic oligonucleotide
gctagaaccgcggagcgtacaccgc

SEQ ID NO: 731876 - DNA, 25 bp, Artificial sequence
  Synthetic oligonucleotide
actggttatccgtccggcggccacg

SEQ ID NO: 731877 - DNA, 25 bp, Artificial sequence
  Synthetic oligonucleotide
actggttatccgaccggcggccacg

SEQ ID NO: 731878 - DNA, 25 bp, Artificial sequence
  Synthetic oligonucleotide
gcttatctagcgccatcgcggcccc

SEQ ID NO: 731879 - DNA, 25 bp, Artificial sequence
  Synthetic oligonucleotide
gcttatctagcggcatcgcggcccc

SEQ ID NO: 731880 - DNA, 25 bp, Artificial sequence
  Synthetic oligonucleotide
ggcgccatagcgctcgcgtacctag

SEQ ID NO: 731881 - DNA, 25 bp, Artificial sequence
  Synthetic oligonucleotide
agatcccgcgacgcgtacacagcgg

SEQ ID NO: 731882 - DNA, 25 bp, Artificial sequence
  Synthetic oligonucleotide
tccctgcgctagcgcgaacccccat

SEQ ID NO: 731883 - DNA, 25 bp, Artificial sequence
  Synthetic oligonucleotide
aagtcgtacgccgtccgcaggtccc

SEQ ID NO: 731884 - DNA, 25 bp, Artificial sequence
  Synthetic oligonucleotide
agcgcgtatcgacggccgctcgcta

SEQ ID NO: 731885 - DNA, 25 bp, Artificial sequence
  Synthetic oligonucleotide
agcgcgtatcgagggccgctcgcta

SEQ ID NO: 731886 - DNA, 25 bp, Artificial sequence
  Synthetic oligonucleotide
cgccgagtagacggtcgacttgcgc

SEQ ID NO: 731887 - DNA, 25 bp, Artificial sequence
  Synthetic oligonucleotide
cgccgagtagaccgtcgacttgcgc

SEQ ID NO: 731888 - DNA, 25 bp, Artificial sequence
  Synthetic oligonucleotide
cccgccgcgataggccggtcaatga

SEQ ID NO: 731889 - DNA, 25 bp, Artificial sequence
  Synthetic oligonucleotide
cccgccgcgatacgccggtcaatga

SEQ ID NO: 731890 - DNA, 25 bp, Artificial sequence
  Synthetic oligonucleotide
ctgccgggtagcctcgacaaccagc

SEQ ID NO: 731891 - DNA, 25 bp, Artificial sequence
  Synthetic oligonucleotide
ctgccgggtagcgtcgacaaccagc

SEQ ID NO: 731892 - DNA, 25 bp, Artificial sequence
  Synthetic oligonucleotide
cacacccgccttacgaccgggatcg

SEQ ID NO: 731893 - DNA, 25 bp, Artificial sequence
  Synthetic oligonucleotide
gacggtcgtatgcgggccacgtctg

SEQ ID NO: 731894 - DNA, 25 bp, Artificial sequence
  Synthetic oligonucleotide
tccctgcgctagggcgaacccccat

SEQ ID NO: 731895 - DNA, 25 bp, Artificial sequence
  Synthetic oligonucleotide
acagacccgtccgaaacgccagccg

SEQ ID NO: 731896 - DNA, 25 bp, Artificial sequence
  Synthetic oligonucleotide
ggcctaccgtgactagtcggctccc

SEQ ID NO: 731897 - DNA, 25 bp, Artificial sequence
  Synthetic oligonucleotide
ggcctaccgtgagtagtcggctccc

SEQ ID NO: 731898 - DNA, 25 bp, Artificial sequence
  Synthetic oligonucleotide
tccagccgtacgccgtcgagtgcac

SEQ ID NO: 731899 - DNA, 25 bp, Artificial sequence
  Synthetic oligonucleotide
tccagccgtacggcgtcgagtgcac

SEQ ID NO: 731900 - DNA, 25 bp, Artificial sequence
  Synthetic oligonucleotide
tcccgcagtaagacgcgcgacgacg

SEQ ID NO: 731901 - DNA, 25 bp, Artificial sequence
  Synthetic oligonucleotide
tcccgcagtaagtcgcgcgacgacg

SEQ ID NO: 731902 - DNA, 25 bp, Artificial sequence
  Synthetic oligonucleotide
ggtccgaccgtttctcgcgggatcg

SEQ ID NO: 731903 - DNA, 25 bp, Artificial sequence
  Synthetic oligonucleotide
ccgatgcgttgcccgtgcatcgtcc

SEQ ID NO: 731904 - DNA, 25 bp, Artificial sequence
  Synthetic oligonucleotide
ccgatgcgttgcgcgtgcatcgtcc

SEQ ID NO: 731905 - DNA, 25 bp, Artificial sequence
  Synthetic oligonucleotide
aagtcgtacgccctccgcaggtccc

SEQ ID NO: 731906 - DNA, 25 bp, Artificial sequence
  Synthetic oligonucleotide
cacacccgcctttcgaccgggatcg

SEQ ID NO: 731907 - DNA, 25 bp, Artificial sequence
  Synthetic oligonucleotide
accatgccggtagcgcatacggccg

SEQ ID NO: 731908 - DNA, 25 bp, Artificial sequence
  Synthetic oligonucleotide
cagggctccctaggcgtcggcactt

SEQ ID NO: 731909 - DNA, 25 bp, Artificial sequence
  Synthetic oligonucleotide
catgtgcctacgccgtaacccggcg

SEQ ID NO: 731910 - DNA, 25 bp, Artificial sequence
  Synthetic oligonucleotide
accggacccgtacgcatcggtgtgc

SEQ ID NO: 731911 - DNA, 25 bp, Artificial sequence
  Synthetic oligonucleotide
accggacccgtaggcatcggtgtgc

SEQ ID NO: 731912 - DNA, 25 bp, Artificial sequence
  Synthetic oligonucleotide
ctggctaccgcgtagatcggccgca

SEQ ID NO: 731913 - DNA, 25 bp, Artificial sequence
  Synthetic oligonucleotide
ctggctaccgcgaagatcggccgca

SEQ ID NO: 731914 - DNA, 25 bp, Artificial sequence
  Synthetic oligonucleotide
ccaaaggtctacacgcgcgtcgggc

SEQ ID NO: 731915 - DNA, 25 bp, Artificial sequence
  Synthetic oligonucleotide
ccaaaggtctactcgcgcgtcgggc

SEQ ID NO: 731916 - DNA, 25 bp, Artificial sequence
  Synthetic oligonucleotide
gagactcgtcgcggactagggcgtg

SEQ ID NO: 731917 - DNA, 25 bp, Artificial sequence
  Synthetic oligonucleotide
gagactcgtcgccgactagggcgtg

SEQ ID NO: 731918 - DNA, 25 bp, Artificial sequence
  Synthetic oligonucleotide
gacggtcgtatgggggccacgtctg

SEQ ID NO: 731919 - DNA, 25 bp, Artificial sequence
  Synthetic oligonucleotide
gtcaggaatgcgctccgcgcgcatg

SEQ ID NO: 731920 - DNA, 25 bp, Artificial sequence
  Synthetic oligonucleotide
catgtgcctacggcgtaacccggcg

SEQ ID NO: 731921 - DNA, 25 bp, Artificial sequence
  Synthetic oligonucleotide
accatgccggtaccgcatacggccg

SEQ ID NO: 731922 - DNA, 25 bp, Artificial sequence
  Synthetic oligonucleotide
ggcgacccggacgctagttgcctac

SEQ ID NO: 731923 - DNA, 25 bp, Artificial sequence
  Synthetic oligonucleotide
ggcgacccggaccctagttgcctac

SEQ ID NO: 731924 - DNA, 25 bp, Artificial sequence
  Synthetic oligonucleotide
tggtcgctatcgtaagcggggcggc

SEQ ID NO: 731925 - DNA, 25 bp, Artificial sequence
  Synthetic oligonucleotide
tggtcgctatcgaaagcggggcggc

SEQ ID NO: 731926 - DNA, 25 bp, Artificial sequence
  Synthetic oligonucleotide
tcgtgctcgcgccagactagccagc

SEQ ID NO: 731927 - DNA, 25 bp, Artificial sequence
  Synthetic oligonucleotide
tcgtgctcgcgcgagactagccagc

SEQ ID NO: 731928 - DNA, 25 bp, Artificial sequence
  Synthetic oligonucleotide
gcgaagcggtccggattaacgcgcg

SEQ ID NO: 731929 - DNA, 25 bp, Artificial sequence
  Synthetic oligonucleotide
gcgaagcggtcccgattaacgcgcg

SEQ ID NO: 731930 - DNA, 25 bp, Artificial sequence
  Synthetic oligonucleotide
acagacccgtcccaaacgccagccg

SEQ ID NO: 731931 - DNA, 25 bp, Artificial sequence
  Synthetic oligonucleotide
gtcaggaatgcggtccgcgcgcatg

SEQ ID NO: 731932 - DNA, 25 bp, Artificial sequence
  Synthetic oligonucleotide
ggcccaaagctacgcgtcgtgggac

SEQ ID NO: 731933 - DNA, 25 bp, Artificial sequence
  Synthetic oligonucleotide
cgcgcttaccgcctgtcgtccggtt

SEQ ID NO: 731934 - DNA, 25 bp, Artificial sequence
  Synthetic oligonucleotide
cgcgcttaccgcgtgtcgtccggtt

SEQ ID NO: 731935 - DNA, 25 bp, Artificial sequence
  Synthetic oligonucleotide
ggggaacgccactagcggtccacgt

SEQ ID NO: 731936 - DNA, 25 bp, Artificial sequence
  Synthetic oligonucleotide
ggggaacgccacaagcggtccacgt

SEQ ID NO: 731937 - DNA, 25 bp, Artificial sequence
  Synthetic oligonucleotide
cgggctacgcgcacgtatgctcgag

SEQ ID NO: 731938 - DNA, 25 bp, Artificial sequence
  Synthetic oligonucleotide
cgggctacgcgctcgtatgctcgag

SEQ ID NO: 731939 - DNA, 25 bp, Artificial sequence
  Synthetic oligonucleotide
gcccagccccgtgtcgcgagcttaa

SEQ ID NO: 731940 - DNA, 25 bp, Artificial sequence
  Synthetic oligonucleotide
gcccagccccgtctcgcgagcttaa

SEQ ID NO: 731941 - DNA, 25 bp, Artificial sequence
  Synthetic oligonucleotide
gtccctgcgaccttcgacggttccc

SEQ ID NO: 731942 - DNA, 25 bp, Artificial sequence
  Synthetic oligonucleotide
gtccctgcgaccatcgacggttccc

SEQ ID NO: 731943 - DNA, 25 bp, Artificial sequence
  Synthetic oligonucleotide
gtagctgcgccgtacgacacgctgc

SEQ ID NO: 731944 - DNA, 25 bp, Artificial sequence
  Synthetic oligonucleotide
cgttgtcggaccgcgatcaggagcg

SEQ ID NO: 731945 - DNA, 25 bp, Artificial sequence
  Synthetic oligonucleotide
cgttgtcggaccccgatcaggagcg

SEQ ID NO: 731946 - DNA, 25 bp, Artificial sequence
  Synthetic oligonucleotide
cgcatgcgatacgcgccgtgcggaa

SEQ ID NO: 731947 - DNA, 25 bp, Artificial sequence
  Synthetic oligonucleotide
ccgggcttcgcgcacaggtcagaga

SEQ ID NO: 731948 - DNA, 25 bp, Artificial sequence
  Synthetic oligonucleotide
ccgggcttcgcggacaggtcagaga

SEQ ID NO: 731949 - DNA, 25 bp, Artificial sequence
  Synthetic oligonucleotide
cgcgctcgtagcgctagagcgatgg

SEQ ID NO: 731950 - DNA, 25 bp, Artificial sequence
  Synthetic oligonucleotide
cgcgctcgtagccctagagcgatgg

SEQ ID NO: 731951 - DNA, 25 bp, Artificial sequence
  Synthetic oligonucleotide
gacgcgacacggaacgtcggggtac

SEQ ID NO: 731952 - DNA, 25 bp, Artificial sequence
  Synthetic oligonucleotide
gacgcgacacggtacgtcggggtac

SEQ ID NO: 731953 - DNA, 25 bp, Artificial sequence
  Synthetic oligonucleotide
ccacggctagcgcaacggggctgtt

SEQ ID NO: 731954 - DNA, 25 bp, Artificial sequence
  Synthetic oligonucleotide
ccacggctagcggaacggggctgtt

SEQ ID NO: 731955 - DNA, 25 bp, Artificial sequence
  Synthetic oligonucleotide
tcggggatagatggcgcgcgcgtga

SEQ ID NO: 731956 - DNA, 25 bp, Artificial sequence
  Synthetic oligonucleotide
tcggggatagatcgcgcgcgcgtga

SEQ ID NO: 731957 - DNA, 25 bp, Artificial sequence
  Synthetic oligonucleotide
tgggcgggcgcgtactcgatagggt

SEQ ID NO: 731958 - DNA, 25 bp, Artificial sequence
  Synthetic oligonucleotide
cgcatgcgatacccgccgtgcggaa

SEQ ID NO: 731959 - DNA, 25 bp, Artificial sequence
  Synthetic oligonucleotide
gtagctgcgccgaacgacacgctgc

SEQ ID NO: 731960 - DNA, 25 bp, Artificial sequence
  Synthetic oligonucleotide
atgaggccgtgaccgcgtagccggt

SEQ ID NO: 731961 - DNA, 25 bp, Artificial sequence
  Synthetic oligonucleotide
atgaggccgtgagcgcgtagccggt

SEQ ID NO: 731962 - DNA, 25 bp, Artificial sequence
  Synthetic oligonucleotide
ccatccacgcgtaccgctacgtgcg

SEQ ID NO: 731963 - DNA, 25 bp, Artificial sequence
  Synthetic oligonucleotide
tgggcgggcgcgaactcgatagggt

SEQ ID NO: 731964 - DNA, 25 bp, Artificial sequence
  Synthetic oligonucleotide
ggcccaaagctaggcgtcgtgggac

SEQ ID NO: 731965 - DNA, 25 bp, Artificial sequence
  Synthetic oligonucleotide
ctcgtgcggtccccggtttgccatg

SEQ ID NO: 731966 - DNA, 25 bp, Artificial sequence
  Synthetic oligonucleotide
ctcgtgcggtccgcggtttgccatg

SEQ ID NO: 731967 - DNA, 25 bp, Artificial sequence
  Synthetic oligonucleotide
tcacccacgccttaacccgcgtcgg

SEQ ID NO: 731968 - DNA, 25 bp, Artificial sequence
  Synthetic oligonucleotide
tcacccacgcctaaacccgcgtcgg

SEQ ID NO: 731969 - DNA, 25 bp, Artificial sequence
  Synthetic oligonucleotide
cgagcgcggcgtcggtactgtagac

SEQ ID NO: 731970 - DNA, 25 bp, Artificial sequence
  Synthetic oligonucleotide
ccatccacgcgttccgctacgtgcg

SEQ ID NO: 731971 - DNA, 25 bp, Artificial sequence
  Synthetic oligonucleotide
cgagcgcggcgtgggtactgtagac

SEQ ID NO: 731972 - DNA, 25 bp, Artificial sequence
  Synthetic oligonucleotide
gacggcgacgttggaccgcggtact

SEQ ID NO: 731973 - DNA, 25 bp, Artificial sequence
  Synthetic oligonucleotide
cattgccgataccccgacggaggcc

SEQ ID NO: 731974 - DNA, 25 bp, Artificial sequence
  Synthetic oligonucleotide
cattgccgatacgccgacggaggcc

SEQ ID NO: 731975 - DNA, 25 bp, Artificial sequence
  Synthetic oligonucleotide
tccatggcgccgctctagtgggtcc

SEQ ID NO: 731976 - DNA, 25 bp, Artificial sequence
  Synthetic oligonucleotide
tccatggcgccggtctagtgggtcc

SEQ ID NO: 731977 - DNA, 25 bp, Artificial sequence
  Synthetic oligonucleotide
gccgttagcgtcctgcgacgcaagc

SEQ ID NO: 731978 - DNA, 25 bp, Artificial sequence
  Synthetic oligonucleotide
gccgttagcgtcgtgcgacgcaagc

SEQ ID NO: 731979 - DNA, 25 bp, Artificial sequence
  Synthetic oligonucleotide
cgagggaatgcggaacccgtcgcga

SEQ ID NO: 731980 - DNA, 25 bp, Artificial sequence
  Synthetic oligonucleotide
cgagggaatgcgcaacccgtcgcga

SEQ ID NO: 731981 - DNA, 25 bp, Artificial sequence
  Synthetic oligonucleotide
gacggcgacgttcgaccgcggtact

SEQ ID NO: 731982 - DNA, 25 bp, Artificial sequence
  Synthetic oligonucleotide
gccggttaccgcggctcgacccact

SEQ ID NO: 731983 - DNA, 25 bp, Artificial sequence
  Synthetic oligonucleotide
gctagcctaacgtccgcccgccagg

SEQ ID NO: 731984 - DNA, 25 bp, Artificial sequence
  Synthetic oligonucleotide
gctagcctaacgaccgcccgccagg

SEQ ID NO: 731985 - DNA, 25 bp, Artificial sequence
  Synthetic oligonucleotide
cccggaacgtatcgccgcgtcccag

SEQ ID NO: 731986 - DNA, 25 bp, Artificial sequence
  Synthetic oligonucleotide
cccggaacgtatggccgcgtcccag

SEQ ID NO: 731987 - DNA, 25 bp, Artificial sequence
  Synthetic oligonucleotide
cgctgccgtcctaccggtcggtcct

SEQ ID NO: 731988 - DNA, 25 bp, Artificial sequence
  Synthetic oligonucleotide
cgctgccgtccttccggtcggtcct

SEQ ID NO: 731989 - DNA, 25 bp, Artificial sequence
  Synthetic oligonucleotide
gccggttaccgccgctcgacccact

SEQ ID NO: 731990 - DNA, 25 bp, Artificial sequence
  Synthetic oligonucleotide
ggcgaccccgtcttcgcgaatccgg

SEQ ID NO: 731991 - DNA, 25 bp, Artificial sequence
  Synthetic oligonucleotide
ccggctcccgcggtattcggttggg

SEQ ID NO: 731992 - DNA, 25 bp, Artificial sequence
  Synthetic oligonucleotide
ggcgaccccgtcatcgcgaatccgg

SEQ ID NO: 731993 - DNA, 25 bp, Artificial sequence
  Synthetic oligonucleotide
ccggctcccgcgctattcggttggg

SEQ ID NO: 731994 - DNA, 25 bp, Artificial sequence
  Synthetic oligonucleotide
gctcgcccgacgggtcgaaggtgct

SEQ ID NO: 731995 - DNA, 25 bp, Artificial sequence
  Synthetic oligonucleotide
gctcgcccgacgcgtcgaaggtgct

SEQ ID NO: 731996 - DNA, 25 bp, Artificial sequence
  Synthetic oligonucleotide
tggagcgtaacggacgccgccgcac

SEQ ID NO: 731997 - DNA, 25 bp, Artificial sequence
  Synthetic oligonucleotide
tggagcgtaacgcacgccgccgcac

SEQ ID NO: 731998 - DNA, 25 bp, Artificial sequence
  Synthetic oligonucleotide
cccccgcgtactgtcgggtcacacc

SEQ ID NO: 731999 - DNA, 25 bp, Artificial sequence
  Synthetic oligonucleotide
cccccgcgtactctcgggtcacacc

SEQ ID NO: 732000 - DNA, 25 bp, Artificial sequence
  Synthetic oligonucleotide
gccccgacggtcgatcccctcgcat

SEQ ID NO: 732001 - DNA, 25 bp, Artificial sequence
  Synthetic oligonucleotide
gccccgacggtccatcccctcgcat

SEQ ID NO: 732002 - DNA, 25 bp, Artificial sequence
  Synthetic oligonucleotide
ccaggacgcgcccgttaagacggcg

SEQ ID NO: 732003 - DNA, 25 bp, Artificial sequence
  Synthetic oligonucleotide
ccaggacgcgccggttaagacggcg

SEQ ID NO: 732004 - DNA, 25 bp, Artificial sequence
  Synthetic oligonucleotide
gcgggtgcgatcctgcgtaaggcgg

SEQ ID NO: 732005 - DNA, 25 bp, Artificial sequence
  Synthetic oligonucleotide
gcgggtgcgatcgtgcgtaaggcgg

SEQ ID NO: 732006 - DNA, 25 bp, Artificial sequence
  Synthetic oligonucleotide
tccgcttatacgcggcccggagccc

SEQ ID NO: 732007 - DNA, 25 bp, Artificial sequence
  Synthetic oligonucleotide
gtcgctattcgcgcgcccatccgcg

SEQ ID NO: 732008 - DNA, 25 bp, Artificial sequence
  Synthetic oligonucleotide
cccgacgaatatgcggcgccctgcg

SEQ ID NO: 732009 - DNA, 25 bp, Artificial sequence
  Synthetic oligonucleotide
gggtagacgcgtcgctaggcgagcc

SEQ ID NO: 732010 - DNA, 25 bp, Artificial sequence
  Synthetic oligonucleotide
gggtagacgcgtggctaggcgagcc

SEQ ID NO: 732011 - DNA, 25 bp, Artificial sequence
  Synthetic oligonucleotide
gcgggcgcgttaggatacccggctc

SEQ ID NO: 732012 - DNA, 25 bp, Artificial sequence
  Synthetic oligonucleotide
gcgggcgcgttacgatacccggctc

SEQ ID NO: 732013 - DNA, 25 bp, Artificial sequence
  Synthetic oligonucleotide
tggcgcttcgcccaccgtcctctgg

SEQ ID NO: 732014 - DNA, 25 bp, Artificial sequence
  Synthetic oligonucleotide
tggcgcttcgccgaccgtcctctgg

SEQ ID NO: 732015 - DNA, 25 bp, Artificial sequence
  Synthetic oligonucleotide
acccctcggcgcctactgtctcggg

SEQ ID NO: 732016 - DNA, 25 bp, Artificial sequence
  Synthetic oligonucleotide
acccctcggcgcgtactgtctcggg

SEQ ID NO: 732017 - DNA, 25 bp, Artificial sequence
  Synthetic oligonucleotide
cccgacgaatatccggcgccctgcg

SEQ ID NO: 732018 - DNA, 25 bp, Artificial sequence
  Synthetic oligonucleotide
tggtcggcgctatccgcgtgaccgc

SEQ ID NO: 732019 - DNA, 25 bp, Artificial sequence
  Synthetic oligonucleotide
cgctcgctcgggcgtaacgccgcta

SEQ ID NO: 732020 - DNA, 25 bp, Artificial sequence
  Synthetic oligonucleotide
tccgcttatacggggcccggagccc

SEQ ID NO: 732021 - DNA, 25 bp, Artificial sequence
  Synthetic oligonucleotide
cgcggccgatacgccacgtgttccc

SEQ ID NO: 732022 - DNA, 25 bp, Artificial sequence
  Synthetic oligonucleotide
cgcggccgataccccacgtgttccc

SEQ ID NO: 732023 - DNA, 25 bp, Artificial sequence
  Synthetic oligonucleotide
ggcgttggcgcttcgtcgaccggag

SEQ ID NO: 732024 - DNA, 25 bp, Artificial sequence
  Synthetic oligonucleotide
ggcgttggcgctacgtcgaccggag

SEQ ID NO: 732025 - DNA, 25 bp, Artificial sequence
  Synthetic oligonucleotide
ccgcccgacttcccgcgattccggt

SEQ ID NO: 732026 - DNA, 25 bp, Artificial sequence
  Synthetic oligonucleotide
ccgcccgacttcgcgcgattccggt

SEQ ID NO: 732027 - DNA, 25 bp, Artificial sequence
  Synthetic oligonucleotide
cctccatacgcagcgaccgtcgccg

SEQ ID NO: 732028 - DNA, 25 bp, Artificial sequence
  Synthetic oligonucleotide
cctccatacgcaccgaccgtcgccg

SEQ ID NO: 732029 - DNA, 25 bp, Artificial sequence
  Synthetic oligonucleotide
cgctcgctcgggggtaacgccgcta

SEQ ID NO: 732030 - DNA, 25 bp, Artificial sequence
  Synthetic oligonucleotide
tggtcggcgctaaccgcgtgaccgc

SEQ ID NO: 732031 - DNA, 25 bp, Artificial sequence
  Synthetic oligonucleotide
accgcaatacgcgcggacgcccctg

SEQ ID NO: 732032 - DNA, 25 bp, Artificial sequence
  Synthetic oligonucleotide
ggcaggcgcatgacggttgggcgga

SEQ ID NO: 732033 - DNA, 25 bp, Artificial sequence
  Synthetic oligonucleotide
tccggcacgaccggtgcgtcggtgt

SEQ ID NO: 732034 - DNA, 25 bp, Artificial sequence
  Synthetic oligonucleotide
tccggcacgacccgtgcgtcggtgt

SEQ ID NO: 732035 - DNA, 25 bp, Artificial sequence
  Synthetic oligonucleotide
cccgaagccgtaggcggatgcgcct

SEQ ID NO: 732036 - DNA, 25 bp, Artificial sequence
  Synthetic oligonucleotide
cccgaagccgtacgcggatgcgcct

SEQ ID NO: 732037 - DNA, 25 bp, Artificial sequence
  Synthetic oligonucleotide
tagaggcgcacgagcggtaggggcc

SEQ ID NO: 732038 - DNA, 25 bp, Artificial sequence
  Synthetic oligonucleotide
tagaggcgcacgtgcggtaggggcc

SEQ ID NO: 732039 - DNA, 25 bp, Artificial sequence
  Synthetic oligonucleotide
tcacggctgccgcgcgctacgcaag

SEQ ID NO: 732040 - DNA, 25 bp, Artificial sequence
  Synthetic oligonucleotide
tcacggctgccgggcgctacgcaag

SEQ ID NO: 732041 - DNA, 25 bp, Artificial sequence
  Synthetic oligonucleotide
ggctccctgcggacgcgaactacgg

SEQ ID NO: 732042 - DNA, 25 bp, Artificial sequence
  Synthetic oligonucleotide
tgtcgggctagttcccgcgagcccg

SEQ ID NO: 732043 - DNA, 25 bp, Artificial sequence
  Synthetic oligonucleotide
accgcaatacgcccggacgcccctg

SEQ ID NO: 732044 - DNA, 25 bp, Artificial sequence
  Synthetic oligonucleotide
gtcgctattcgcccgcccatccgcg

SEQ ID NO: 732045 - DNA, 25 bp, Artificial sequence
  Synthetic oligonucleotide
ggcgctgtcgtgcgctgtagtgcgc

SEQ ID NO: 732046 - DNA, 25 bp, Artificial sequence
  Synthetic oligonucleotide
ggcgctgtcgtgggctgtagtgcgc

SEQ ID NO: 732047 - DNA, 25 bp, Artificial sequence
  Synthetic oligonucleotide
gcggccggtcgcgcgtgtaaaccct

SEQ ID NO: 732048 - DNA, 25 bp, Artificial sequence
  Synthetic oligonucleotide
gcggccggtcgcccgtgtaaaccct

SEQ ID NO: 732049 - DNA, 25 bp, Artificial sequence
  Synthetic oligonucleotide
ggctgtctagttggcgggccccggt

SEQ ID NO: 732050 - DNA, 25 bp, Artificial sequence
  Synthetic oligonucleotide
ggctgtctagttcgcgggccccggt

SEQ ID NO: 732051 - DNA, 25 bp, Artificial sequence
  Synthetic oligonucleotide
tggacggacctagggcgcgagtccg

SEQ ID NO: 732052 - DNA, 25 bp, Artificial sequence
  Synthetic oligonucleotide
tggacggacctacggcgcgagtccg

SEQ ID NO: 732053 - DNA, 25 bp, Artificial sequence
  Synthetic oligonucleotide
ggggcgacgaatacccgcgcacagg

SEQ ID NO: 732054 - DNA, 25 bp, Artificial sequence
  Synthetic oligonucleotide
tcgtccccgatgtcggacggtcccg

SEQ ID NO: 732055 - DNA, 25 bp, Artificial sequence
  Synthetic oligonucleotide
ggctccctgcggtcgcgaactacgg

SEQ ID NO: 732056 - DNA, 25 bp, Artificial sequence
  Synthetic oligonucleotide
gaggcccgtcggcctaagacgcgca

SEQ ID NO: 732057 - DNA, 25 bp, Artificial sequence
  Synthetic oligonucleotide
cctacgcgtcgatcgtctgggggcc

SEQ ID NO: 732058 - DNA, 25 bp, Artificial sequence
  Synthetic oligonucleotide
gaagggtgttgtcgcgcggcggagc

SEQ ID NO: 732059 - DNA, 25 bp, Artificial sequence
  Synthetic oligonucleotide
gaagggtgttgtggcgcggcggagc

SEQ ID NO: 732060 - DNA, 25 bp, Artificial sequence
  Synthetic oligonucleotide
tcgcgcgtaccgtcgacggccccat

SEQ ID NO: 732061 - DNA, 25 bp, Artificial sequence
  Synthetic oligonucleotide
tcgcgcgtaccgacgacggccccat

SEQ ID NO: 732062 - DNA, 25 bp, Artificial sequence
  Synthetic oligonucleotide
cgccggacgcgccatggatgtcgca

SEQ ID NO: 732063 - DNA, 25 bp, Artificial sequence
  Synthetic oligonucleotide
cgccggacgcgcgatggatgtcgca

SEQ ID NO: 732064 - DNA, 25 bp, Artificial sequence
  Synthetic oligonucleotide
cagagggcgcgaggtacgtggggag

SEQ ID NO: 732065 - DNA, 25 bp, Artificial sequence
  Synthetic oligonucleotide
cagagggcgcgacgtacgtggggag

SEQ ID NO: 732066 - DNA, 25 bp, Artificial sequence
  Synthetic oligonucleotide
ggagtcgcggtaacgcgaaccggcg

SEQ ID NO: 732067 - DNA, 25 bp, Artificial sequence
  Synthetic oligonucleotide
tgtcgggctagtacccgcgagcccg

SEQ ID NO: 732068 - DNA, 25 bp, Artificial sequence
  Synthetic oligonucleotide
gaggcccgtcgggctaagacgcgca

SEQ ID NO: 732069 - DNA, 25 bp, Artificial sequence
  Synthetic oligonucleotide
cctacgcgtcgaacgtctgggggcc

SEQ ID NO: 732070 - DNA, 25 bp, Artificial sequence
  Synthetic oligonucleotide
gaaccccgtcgatcgcgcagggcag

SEQ ID NO: 732071 - DNA, 25 bp, Artificial sequence
  Synthetic oligonucleotide
gaaccccgtcgaacgcgcagggcag

SEQ ID NO: 732072 - DNA, 25 bp, Artificial sequence
  Synthetic oligonucleotide
gtctggtcgtacgggcccggcatgc

SEQ ID NO: 732073 - DNA, 25 bp, Artificial sequence
  Synthetic oligonucleotide
gtctggtcgtaccggcccggcatgc

SEQ ID NO: 732074 - DNA, 25 bp, Artificial sequence
  Synthetic oligonucleotide
cgcagtgacgcgcggttggcagcga

SEQ ID NO: 732075 - DNA, 25 bp, Artificial sequence
  Synthetic oligonucleotide
cgcagtgacgcggggttggcagcga

SEQ ID NO: 732076 - DNA, 25 bp, Artificial sequence
  Synthetic oligonucleotide
actgcgcgcgttccgacgtcgaggg

SEQ ID NO: 732077 - DNA, 25 bp, Artificial sequence
  Synthetic oligonucleotide
actgcgcgcgttgcgacgtcgaggg

SEQ ID NO: 732078 - DNA, 25 bp, Artificial sequence
  Synthetic oligonucleotide
ggcaggcgcatgtcggttgggcgga

SEQ ID NO: 732079 - DNA, 25 bp, Artificial sequence
  Synthetic oligonucleotide
taggcggcgctacgtcggtgcacgc

SEQ ID NO: 732080 - DNA, 25 bp, Artificial sequence
  Synthetic oligonucleotide
ggagtcgcggtatcgcgaaccggcg

SEQ ID NO: 732081 - DNA, 25 bp, Artificial sequence
  Synthetic oligonucleotide
acaccgtcgcaccacgtgccgcagg

SEQ ID NO: 732082 - DNA, 25 bp, Artificial sequence
  Synthetic oligonucleotide
ccgggctgtgcgtcccgtactaccc

SEQ ID NO: 732083 - DNA, 25 bp, Artificial sequence
  Synthetic oligonucleotide
gcccgcgtacgaccgacgcggacaa

SEQ ID NO: 732084 - DNA, 25 bp, Artificial sequence
  Synthetic oligonucleotide
gcccgcgtacgagcgacgcggacaa

SEQ ID NO: 732085 - DNA, 25 bp, Artificial sequence
  Synthetic oligonucleotide
gagtgcgcgggctagtacgcgccga

SEQ ID NO: 732086 - DNA, 25 bp, Artificial sequence
  Synthetic oligonucleotide
gagtgcgcgggcaagtacgcgccga

SEQ ID NO: 732087 - DNA, 25 bp, Artificial sequence
  Synthetic oligonucleotide
gcgcccggcatagtagcgggagtgg

SEQ ID NO: 732088 - DNA, 25 bp, Artificial sequence
  Synthetic oligonucleotide
gcgcccggcatactagcgggagtgg

SEQ ID NO: 732089 - DNA, 25 bp, Artificial sequence
  Synthetic oligonucleotide
cggggcaggcgcggtaacgatcgac

SEQ ID NO: 732090 - DNA, 25 bp, Artificial sequence
  Synthetic oligonucleotide
cggggcaggcgccgtaacgatcgac

SEQ ID NO: 732091 - DNA, 25 bp, Artificial sequence
  Synthetic oligonucleotide
gactatccggcgggactgtcgggcg

SEQ ID NO: 732092 - DNA, 25 bp, Artificial sequence
  Synthetic oligonucleotide
aggggccgagctaaccgcgccacga

SEQ ID NO: 732093 - DNA, 25 bp, Artificial sequence
  Synthetic oligonucleotide
acaccgtcgcacgacgtgccgcagg

SEQ ID NO: 732094 - DNA, 25 bp, Artificial sequence
  Synthetic oligonucleotide
gtccgctcgcgcctatggtcgagcc

SEQ ID NO: 732095 - DNA, 25 bp, Artificial sequence
  Synthetic oligonucleotide
gcgtacgcgctatcgggcgccacag

SEQ ID NO: 732096 - DNA, 25 bp, Artificial sequence
  Synthetic oligonucleotide
gcgtacgcgctaacgggcgccacag

SEQ ID NO: 732097 - DNA, 25 bp, Artificial sequence
  Synthetic oligonucleotide
cacggacgcggctacgtacggcgca

SEQ ID NO: 732098 - DNA, 25 bp, Artificial sequence
  Synthetic oligonucleotide
cacggacgcggcaacgtacggcgca

SEQ ID NO: 732099 - DNA, 25 bp, Artificial sequence
  Synthetic oligonucleotide
gcccccacttcgggcgtgtgtccgt

SEQ ID NO: 732100 - DNA, 25 bp, Artificial sequence
  Synthetic oligonucleotide
gcccccacttcgcgcgtgtgtccgt

SEQ ID NO: 732101 - DNA, 25 bp, Artificial sequence
  Synthetic oligonucleotide
gggtcggtcgtcaacgcgcgactgg

SEQ ID NO: 732102 - DNA, 25 bp, Artificial sequence
  Synthetic oligonucleotide
gggtcggtcgtctacgcgcgactgg

SEQ ID NO: 732103 - DNA, 25 bp, Artificial sequence
  Synthetic oligonucleotide
cacgcgcgggtcgcgtatagcccac

SEQ ID NO: 732104 - DNA, 25 bp, Artificial sequence
  Synthetic oligonucleotide
cacgcgcgggtcccgtatagcccac

SEQ ID NO: 732105 - DNA, 25 bp, Artificial sequence
  Synthetic oligonucleotide
gactatccggcgcgactgtcgggcg

SEQ ID NO: 732106 - DNA, 25 bp, Artificial sequence
  Synthetic oligonucleotide
acacggcgaacgcgggtcggagacg

SEQ ID NO: 732107 - DNA, 25 bp, Artificial sequence
  Synthetic oligonucleotide
cacgcgcgatccggcgaacgctgga

SEQ ID NO: 732108 - DNA, 25 bp, Artificial sequence
  Synthetic oligonucleotide
ggccgagcggtcgactcgtcagctc

SEQ ID NO: 732109 - DNA, 25 bp, Artificial sequence
  Synthetic oligonucleotide
ggtctgcgcgtatgcgagcccggtg

SEQ ID NO: 732110 - DNA, 25 bp, Artificial sequence
  Synthetic oligonucleotide
ggtctgcgcgtaagcgagcccggtg

SEQ ID NO: 732111 - DNA, 25 bp, Artificial sequence
  Synthetic oligonucleotide
tggccgcgcttacgtccgaggccga

SEQ ID NO: 732112 - DNA, 25 bp, Artificial sequence
  Synthetic oligonucleotide
tggccgcgcttaggtccgaggccga

SEQ ID NO: 732113 - DNA, 25 bp, Artificial sequence
  Synthetic oligonucleotide
agacgccgctagctacggggtcgcg

SEQ ID NO: 732114 - DNA, 25 bp, Artificial sequence
  Synthetic oligonucleotide
agacgccgctaggtacggggtcgcg

SEQ ID NO: 732115 - DNA, 25 bp, Artificial sequence
  Synthetic oligonucleotide
gcgcgcggaacgacgcggttttgcg

SEQ ID NO: 732116 - DNA, 25 bp, Artificial sequence
  Synthetic oligonucleotide
gcgcgcggaacgtcgcggttttgcg

SEQ ID NO: 732117 - DNA, 25 bp, Artificial sequence
  Synthetic oligonucleotide
aggggccgagcttaccgcgccacga

SEQ ID NO: 732118 - DNA, 25 bp, Artificial sequence
  Synthetic oligonucleotide
cgggccttcgacggcgttcaggcac

SEQ ID NO: 732119 - DNA, 25 bp, Artificial sequence
  Synthetic oligonucleotide
tcgtccccgatgacggacggtcccg

SEQ ID NO: 732120 - DNA, 25 bp, Artificial sequence
  Synthetic oligonucleotide
acacggcgaacgggggtcggagacg

SEQ ID NO: 732121 - DNA, 25 bp, Artificial sequence
  Synthetic oligonucleotide
ggcggagttccgcgcttcggcgtac

SEQ ID NO: 732122 - DNA, 25 bp, Artificial sequence
  Synthetic oligonucleotide
ggcggagttccgggcttcggcgtac

SEQ ID NO: 732123 - DNA, 25 bp, Artificial sequence
  Synthetic oligonucleotide
gtgtcggctacgatccgccggtccg

SEQ ID NO: 732124 - DNA, 25 bp, Artificial sequence
  Synthetic oligonucleotide
gtgtcggctacgttccgccggtccg

SEQ ID NO: 732125 - DNA, 25 bp, Artificial sequence
  Synthetic oligonucleotide
ctcccgggggcgaattacgcacgcg

SEQ ID NO: 732126 - DNA, 25 bp, Artificial sequence
  Synthetic oligonucleotide
ctcccgggggcgtattacgcacgcg

SEQ ID NO: 732127 - DNA, 25 bp, Artificial sequence
  Synthetic oligonucleotide
tcagctcgactcgcctacggcgccc

SEQ ID NO: 732128 - DNA, 25 bp, Artificial sequence
  Synthetic oligonucleotide
tcagctcgactcccctacggcgccc

SEQ ID NO: 732129 - DNA, 25 bp, Artificial sequence
  Synthetic oligonucleotide
gtccgctcgcgcgtatggtcgagcc

SEQ ID NO: 732130 - DNA, 25 bp, Artificial sequence
  Synthetic oligonucleotide
cgggccttcgaccgcgttcaggcac

SEQ ID NO: 732131 - DNA, 25 bp, Artificial sequence
  Synthetic oligonucleotide
tcgccgcgcggtttgtccaccgacc

SEQ ID NO: 732132 - DNA, 25 bp, Artificial sequence
  Synthetic oligonucleotide
taggggtcgtaagccgcgcctcgcc

SEQ ID NO: 732133 - DNA, 25 bp, Artificial sequence
  Synthetic oligonucleotide
tccctgtgacgcctagcggtccgcc

SEQ ID NO: 732134 - DNA, 25 bp, Artificial sequence
  Synthetic oligonucleotide
tccctgtgacgcgtagcggtccgcc

SEQ ID NO: 732135 - DNA, 25 bp, Artificial sequence
  Synthetic oligonucleotide
catcccgtcgaccgtacgcgccgag

SEQ ID NO: 732136 - DNA, 25 bp, Artificial sequence
  Synthetic oligonucleotide
catcccgtcgacggtacgcgccgag

SEQ ID NO: 732137 - DNA, 25 bp, Artificial sequence
  Synthetic oligonucleotide
ccgggactaccgtcgctcgagcgtc

SEQ ID NO: 732138 - DNA, 25 bp, Artificial sequence
  Synthetic oligonucleotide
ccgggactaccgacgctcgagcgtc

SEQ ID NO: 732139 - DNA, 25 bp, Artificial sequence
  Synthetic oligonucleotide
gcggtcgacggtcgttccgtgccca

SEQ ID NO: 732140 - DNA, 25 bp, Artificial sequence
  Synthetic oligonucleotide
gcggtcgacggtggttccgtgccca

SEQ ID NO: 732141 - DNA, 25 bp, Artificial sequence
  Synthetic oligonucleotide
gggcactatgcgcgatcgggcgcgt

SEQ ID NO: 732142 - DNA, 25 bp, Artificial sequence
  Synthetic oligonucleotide
ccgcagtcgcgcctatgcggatgcc

SEQ ID NO: 732143 - DNA, 25 bp, Artificial sequence
  Synthetic oligonucleotide
tcgccgcgcggtatgtccaccgacc

SEQ ID NO: 732144 - DNA, 25 bp, Artificial sequence
  Synthetic oligonucleotide
ggagaggacgggacgactcgcgctc

SEQ ID NO: 732145 - DNA, 25 bp, Artificial sequence
  Synthetic oligonucleotide
ggccgtgtaacgccgcgacccaacg

SEQ ID NO: 732146 - DNA, 25 bp, Artificial sequence
  Synthetic oligonucleotide
ggccgtgtaacggcgcgacccaacg

SEQ ID NO: 732147 - DNA, 25 bp, Artificial sequence
  Synthetic oligonucleotide
ccgtgccgcatactacggccccgtc

SEQ ID NO: 732148 - DNA, 25 bp, Artificial sequence
  Synthetic oligonucleotide
ccgtgccgcatagtacggccccgtc

SEQ ID NO: 732149 - DNA, 25 bp, Artificial sequence
  Synthetic oligonucleotide
acgcctgtaggtacgcgcgggacgc

SEQ ID NO: 732150 - DNA, 25 bp, Artificial sequence
  Synthetic oligonucleotide
acgcctgtaggttcgcgcgggacgc

SEQ ID NO: 732151 - DNA, 25 bp, Artificial sequence
  Synthetic oligonucleotide
cccgtctagcgcctcggatccgcac

SEQ ID NO: 732152 - DNA, 25 bp, Artificial sequence
  Synthetic oligonucleotide
cccgtctagcgcgtcggatccgcac

SEQ ID NO: 732153 - DNA, 25 bp, Artificial sequence
  Synthetic oligonucleotide
ggcgctgtcatagcgccgtctggcg

SEQ ID NO: 732154 - DNA, 25 bp, Artificial sequence
  Synthetic oligonucleotide
ggcgctgtcataccgccgtctggcg

SEQ ID NO: 732155 - DNA, 25 bp, Artificial sequence
  Synthetic oligonucleotide
gggcactatgcgggatcgggcgcgt

SEQ ID NO: 732156 - DNA, 25 bp, Artificial sequence
  Synthetic oligonucleotide
cctggcgtacgtagccgcgccaggt

SEQ ID NO: 732157 - DNA, 25 bp, Artificial sequence
  Synthetic oligonucleotide
ggggcgacgaattcccgcgcacagg

SEQ ID NO: 732158 - DNA, 25 bp, Artificial sequence
  Synthetic oligonucleotide
cacgcgcgatcccgcgaacgctgga

SEQ ID NO: 732159 - DNA, 25 bp, Artificial sequence
  Synthetic oligonucleotide
ccgggctgtgcgacccgtactaccc

SEQ ID NO: 732160 - DNA, 25 bp, Artificial sequence
  Synthetic oligonucleotide
ggcacggaaggcccgttaccgtccc

SEQ ID NO: 732161 - DNA, 25 bp, Artificial sequence
  Synthetic oligonucleotide
ggcacggaaggcgcgttaccgtccc

SEQ ID NO: 732162 - DNA, 25 bp, Artificial sequence
  Synthetic oligonucleotide
gccccttaggacacccgcgacaggg

SEQ ID NO: 732163 - DNA, 25 bp, Artificial sequence
  Synthetic oligonucleotide
gccccttaggactcccgcgacaggg

SEQ ID NO: 732164 - DNA, 25 bp, Artificial sequence
  Synthetic oligonucleotide
tcttggtcgaaccgccccgcggcgt

SEQ ID NO: 732165 - DNA, 25 bp, Artificial sequence
  Synthetic oligonucleotide
tcttggtcgaacggccccgcggcgt

SEQ ID NO: 732166 - DNA, 25 bp, Artificial sequence
  Synthetic oligonucleotide
ctagcccgagtcgcgctagaggggc

SEQ ID NO: 732167 - DNA, 25 bp, Artificial sequence
  Synthetic oligonucleotide
taggggtcgtaacccgcgcctcgcc

SEQ ID NO: 732168 - DNA, 25 bp, Artificial sequence
  Synthetic oligonucleotide
cctggcgtacgttgccgcgccaggt

SEQ ID NO: 732169 - DNA, 25 bp, Artificial sequence
  Synthetic oligonucleotide
ggagaggacgggtcgactcgcgctc

SEQ ID NO: 732170 - DNA, 25 bp, Artificial sequence
  Synthetic oligonucleotide
ggggccttacgccgacccgtgtcca

SEQ ID NO: 732171 - DNA, 25 bp, Artificial sequence
  Synthetic oligonucleotide
ggggccttacgcggacccgtgtcca

SEQ ID NO: 732172 - DNA, 25 bp, Artificial sequence
  Synthetic oligonucleotide
agcggccgcgggactagcggtgtag

SEQ ID NO: 732173 - DNA, 25 bp, Artificial sequence
  Synthetic oligonucleotide
agcggccgcgggtctagcggtgtag

SEQ ID NO: 732174 - DNA, 25 bp, Artificial sequence
  Synthetic oligonucleotide
cggagctacgcccgtcgcttgcgag

SEQ ID NO: 732175 - DNA, 25 bp, Artificial sequence
  Synthetic oligonucleotide
cggagctacgccggtcgcttgcgag

SEQ ID NO: 732176 - DNA, 25 bp, Artificial sequence
  Synthetic oligonucleotide
ccgcgacgcggaaaactcgtggcgc

SEQ ID NO: 732177 - DNA, 25 bp, Artificial sequence
  Synthetic oligonucleotide
ccgcgacgcggataactcgtggcgc

SEQ ID NO: 732178 - DNA, 25 bp, Artificial sequence
  Synthetic oligonucleotide
ctcacccgtcgcccgaacacggtgc

SEQ ID NO: 732179 - DNA, 25 bp, Artificial sequence
  Synthetic oligonucleotide
ctcacccgtcgcgcgaacacggtgc

SEQ ID NO: 732180 - DNA, 25 bp, Artificial sequence
  Synthetic oligonucleotide
ccgcagtcgcgcgtatgcggatgcc

SEQ ID NO: 732181 - DNA, 25 bp, Artificial sequence
  Synthetic oligonucleotide
ctagcccgagtcccgctagaggggc

SEQ ID NO: 732182 - DNA, 25 bp, Artificial sequence
  Synthetic oligonucleotide
aacgagcccctactcgacgccgggc

SEQ ID NO: 732183 - DNA, 25 bp, Artificial sequence
  Synthetic oligonucleotide
cgctcctacgcgaggtcggaaccgg

SEQ ID NO: 732184 - DNA, 25 bp, Artificial sequence
  Synthetic oligonucleotide
accgcagccgtcgggcgtacccatc

SEQ ID NO: 732185 - DNA, 25 bp, Artificial sequence
  Synthetic oligonucleotide
accgcagccgtccggcgtacccatc

SEQ ID NO: 732186 - DNA, 25 bp, Artificial sequence
  Synthetic oligonucleotide
cgcgccgcgtacaatgccgagggca

SEQ ID NO: 732187 - DNA, 25 bp, Artificial sequence
  Synthetic oligonucleotide
cgcgccgcgtactatgccgagggca

SEQ ID NO: 732188 - DNA, 25 bp, Artificial sequence
  Synthetic oligonucleotide
ggcaggtaccgcggaaccctcgtcc

SEQ ID NO: 732189 - DNA, 25 bp, Artificial sequence
  Synthetic oligonucleotide
ggcaggtaccgccgaaccctcgtcc

SEQ ID NO: 732190 - DNA, 25 bp, Artificial sequence
  Synthetic oligonucleotide
acgggagtccgtaaccgcggctgcc

SEQ ID NO: 732191 - DNA, 25 bp, Artificial sequence
  Synthetic oligonucleotide
acgggagtccgttaccgcggctgcc

SEQ ID NO: 732192 - DNA, 25 bp, Artificial sequence
  Synthetic oligonucleotide
ggagactacgcgtcgcacggtccgc

SEQ ID NO: 732193 - DNA, 25 bp, Artificial sequence
  Synthetic oligonucleotide
acacggacggcgctccgacgcatcc

SEQ ID NO: 732194 - DNA, 25 bp, Artificial sequence
  Synthetic oligonucleotide
aacgagcccctagtcgacgccgggc

SEQ ID NO: 732195 - DNA, 25 bp, Artificial sequence
  Synthetic oligonucleotide
gggcggtattcgggcccgcccagtt

SEQ ID NO: 732196 - DNA, 25 bp, Artificial sequence
  Synthetic oligonucleotide
ccgggagcgatacgccgattccggg

SEQ ID NO: 732197 - DNA, 25 bp, Artificial sequence
  Synthetic oligonucleotide
ccgggagcgataggccgattccggg

SEQ ID NO: 732198 - DNA, 25 bp, Artificial sequence
  Synthetic oligonucleotide
ccccggcttgcgtgtcgacgggaac

SEQ ID NO: 732199 - DNA, 25 bp, Artificial sequence
  Synthetic oligonucleotide
ccccggcttgcgagtcgacgggaac

SEQ ID NO: 732200 - DNA, 25 bp, Artificial sequence
  Synthetic oligonucleotide
tcggagtttcgcgcgaggccggggt

SEQ ID NO: 732201 - DNA, 25 bp, Artificial sequence
  Synthetic oligonucleotide
tcggagtttcgcccgaggccggggt

SEQ ID NO: 732202 - DNA, 25 bp, Artificial sequence
  Synthetic oligonucleotide
cgcttccgcgttaggtcgtccggcg

SEQ ID NO: 732203 - DNA, 25 bp, Artificial sequence
  Synthetic oligonucleotide
cgcttccgcgtttggtcgtccggcg

SEQ ID NO: 732204 - DNA, 25 bp, Artificial sequence
  Synthetic oligonucleotide
cagacgggacggcctacgcgggagt

SEQ ID NO: 732205 - DNA, 25 bp, Artificial sequence
  Synthetic oligonucleotide
cctggggcgtcgcgttaggccacgt

SEQ ID NO: 732206 - DNA, 25 bp, Artificial sequence
  Synthetic oligonucleotide
ggagactacgcgacgcacggtccgc

SEQ ID NO: 732207 - DNA, 25 bp, Artificial sequence
  Synthetic oligonucleotide
ctggcggtcgcgaactcgacctggg

SEQ ID NO: 732208 - DNA, 25 bp, Artificial sequence
  Synthetic oligonucleotide
gcctagggactatcgcgcgagccgg

SEQ ID NO: 732209 - DNA, 25 bp, Artificial sequence
  Synthetic oligonucleotide
gcctagggactaacgcgcgagccgg

SEQ ID NO: 732210 - DNA, 25 bp, Artificial sequence
  Synthetic oligonucleotide
cagcgcgatcgtccgtagcgtccgc

SEQ ID NO: 732211 - DNA, 25 bp, Artificial sequence
  Synthetic oligonucleotide
cagcgcgatcgtgcgtagcgtccgc

SEQ ID NO: 732212 - DNA, 25 bp, Artificial sequence
  Synthetic oligonucleotide
ccttcgggtcgtccgcgtaggagcc

SEQ ID NO: 732213 - DNA, 25 bp, Artificial sequence
  Synthetic oligonucleotide
ccttcgggtcgtgcgcgtaggagcc

SEQ ID NO: 732214 - DNA, 25 bp, Artificial sequence
  Synthetic oligonucleotide
ccaggcgcgctcaagaccggtctcc

SEQ ID NO: 732215 - DNA, 25 bp, Artificial sequence
  Synthetic oligonucleotide
ccaggcgcgctctagaccggtctcc

SEQ ID NO: 732216 - DNA, 25 bp, Artificial sequence
  Synthetic oligonucleotide
gcgcataccgcgaaacggacgccgc

SEQ ID NO: 732217 - DNA, 25 bp, Artificial sequence
  Synthetic oligonucleotide
gcgcataccgcgtaacggacgccgc

SEQ ID NO: 732218 - DNA, 25 bp, Artificial sequence
  Synthetic oligonucleotide
acacggacggcggtccgacgcatcc

SEQ ID NO: 732219 - DNA, 25 bp, Artificial sequence
  Synthetic oligonucleotide
ctccgtccgaacccacgagcgctgg

SEQ ID NO: 732220 - DNA, 25 bp, Artificial sequence
  Synthetic oligonucleotide
cgcttgacgggccagacgtccaggc

SEQ ID NO: 732221 - DNA, 25 bp, Artificial sequence
  Synthetic oligonucleotide
ctggcggtcgcgtactcgacctggg

SEQ ID NO: 732222 - DNA, 25 bp, Artificial sequence
  Synthetic oligonucleotide
acgggggcgcgttacgacgcgcaag

SEQ ID NO: 732223 - DNA, 25 bp, Artificial sequence
  Synthetic oligonucleotide
acgggggcgcgtaacgacgcgcaag

SEQ ID NO: 732224 - DNA, 25 bp, Artificial sequence
  Synthetic oligonucleotide
gagggcacgcttctacgcgctcccc

SEQ ID NO: 732225 - DNA, 25 bp, Artificial sequence
  Synthetic oligonucleotide
gagggcacgcttgtacgcgctcccc

SEQ ID NO: 732226 - DNA, 25 bp, Artificial sequence
  Synthetic oligonucleotide
cggtcctcgcattcggtcgccccca

SEQ ID NO: 732227 - DNA, 25 bp, Artificial sequence
  Synthetic oligonucleotide
cggtcctcgcatacggtcgccccca

SEQ ID NO: 732228 - DNA, 25 bp, Artificial sequence
  Synthetic oligonucleotide
gtgggcacgtaaggagtcgcgcgcc

SEQ ID NO: 732229 - DNA, 25 bp, Artificial sequence
  Synthetic oligonucleotide
gtgggcacgtaacgagtcgcgcgcc

SEQ ID NO: 732230 - DNA, 25 bp, Artificial sequence
  Synthetic oligonucleotide
gggcggtattcgcgcccgcccagtt

SEQ ID NO: 732231 - DNA, 25 bp, Artificial sequence
  Synthetic oligonucleotide
ctccgtccgaacgcacgagcgctgg

SEQ ID NO: 732232 - DNA, 25 bp, Artificial sequence
  Synthetic oligonucleotide
gcgcgttaccgccccggtatcggct

SEQ ID NO: 732233 - DNA, 25 bp, Artificial sequence
  Synthetic oligonucleotide
cagacgggacgggctacgcgggagt

SEQ ID NO: 732234 - DNA, 25 bp, Artificial sequence
  Synthetic oligonucleotide
gcgctggccgtccgggtatgcgtct

SEQ ID NO: 732235 - DNA, 25 bp, Artificial sequence
  Synthetic oligonucleotide
gcgctggccgtcggggtatgcgtct

SEQ ID NO: 732236 - DNA, 25 bp, Artificial sequence
  Synthetic oligonucleotide
gccaccgacgcgagacgtaggccag

SEQ ID NO: 732237 - DNA, 25 bp, Artificial sequence
  Synthetic oligonucleotide
gccaccgacgcgtgacgtaggccag

SEQ ID NO: 732238 - DNA, 25 bp, Artificial sequence
  Synthetic oligonucleotide
gtctgggcgacttccgtccctcccg

SEQ ID NO: 732239 - DNA, 25 bp, Artificial sequence
  Synthetic oligonucleotide
gtctgggcgactaccgtccctcccg

SEQ ID NO: 732240 - DNA, 25 bp, Artificial sequence
  Synthetic oligonucleotide
cgttgccgtcggccgtatgcgcgct

SEQ ID NO: 732241 - DNA, 25 bp, Artificial sequence
  Synthetic oligonucleotide
cgttgccgtcgggcgtatgcgcgct

SEQ ID NO: 732242 - DNA, 25 bp, Artificial sequence
  Synthetic oligonucleotide
gggggtgaactagcgcgacccccac

SEQ ID NO: 732243 - DNA, 25 bp, Artificial sequence
  Synthetic oligonucleotide
tcagctctccgcctacgtccggccg

SEQ ID NO: 732244 - DNA, 25 bp, Artificial sequence
  Synthetic oligonucleotide
gcgcgttaccgcgccggtatcggct

SEQ ID NO: 732245 - DNA, 25 bp, Artificial sequence
  Synthetic oligonucleotide
gacgtcgtccgaggcgatgctgcgg

SEQ ID NO: 732246 - DNA, 25 bp, Artificial sequence
  Synthetic oligonucleotide
gaggtgcggtacgtacccgccagcc

SEQ ID NO: 732247 - DNA, 25 bp, Artificial sequence
  Synthetic oligonucleotide
gaggtgcggtacctacccgccagcc

SEQ ID NO: 732248 - DNA, 25 bp, Artificial sequence
  Synthetic oligonucleotide
tgggtctatccggctacgcgcggcc

SEQ ID NO: 732249 - DNA, 25 bp, Artificial sequence
  Synthetic oligonucleotide
tgggtctatccgcctacgcgcggcc

SEQ ID NO: 732250 - DNA, 25 bp, Artificial sequence
  Synthetic oligonucleotide
ggcgctcgctaagggcggaatgcgc

SEQ ID NO: 732251 - DNA, 25 bp, Artificial sequence
  Synthetic oligonucleotide
ggcgctcgctaacggcggaatgcgc

SEQ ID NO: 732252 - DNA, 25 bp, Artificial sequence
  Synthetic oligonucleotide
cgcgaccgtacgccgggttggcagt

SEQ ID NO: 732253 - DNA, 25 bp, Artificial sequence
  Synthetic oligonucleotide
cgcgaccgtacggcgggttggcagt

SEQ ID NO: 732254 - DNA, 25 bp, Artificial sequence
  Synthetic oligonucleotide
ggccgagcggtccactcgtcagctc

SEQ ID NO: 732255 - DNA, 25 bp, Artificial sequence
  Synthetic oligonucleotide
taggcggcgctaggtcggtgcacgc

SEQ ID NO: 732256 - DNA, 25 bp, Artificial sequence
  Synthetic oligonucleotide
gggggtgaactaccgcgacccccac

SEQ ID NO: 732257 - DNA, 25 bp, Artificial sequence
  Synthetic oligonucleotide
aggcaacgacgtacgtgcgggcccc

SEQ ID NO: 732258 - DNA, 25 bp, Artificial sequence
  Synthetic oligonucleotide
cgccccttcgcgtcggaactggcac

SEQ ID NO: 732259 - DNA, 25 bp, Artificial sequence
  Synthetic oligonucleotide
cgccccttcgcgacggaactggcac

SEQ ID NO: 732260 - DNA, 25 bp, Artificial sequence
  Synthetic oligonucleotide
aggaggcggtcgaccgctaccacgc

SEQ ID NO: 732261 - DNA, 25 bp, Artificial sequence
  Synthetic oligonucleotide
aggaggcggtcgtccgctaccacgc

SEQ ID NO: 732262 - DNA, 25 bp, Artificial sequence
  Synthetic oligonucleotide
gccaggcgtacgactactcggcggg

SEQ ID NO: 732263 - DNA, 25 bp, Artificial sequence
  Synthetic oligonucleotide
gccaggcgtacgtctactcggcggg

SEQ ID NO: 732264 - DNA, 25 bp, Artificial sequence
  Synthetic oligonucleotide
cctcatgtacggtcgggccgccctg

SEQ ID NO: 732265 - DNA, 25 bp, Artificial sequence
  Synthetic oligonucleotide
cctcatgtacggacgggccgccctg

SEQ ID NO: 732266 - DNA, 25 bp, Artificial sequence
  Synthetic oligonucleotide
tcgcgcgacgcaagcggacgggact

SEQ ID NO: 732267 - DNA, 25 bp, Artificial sequence
  Synthetic oligonucleotide
tcgcgcgacgcatgcggacgggact

SEQ ID NO: 732268 - DNA, 25 bp, Artificial sequence
  Synthetic oligonucleotide
tcagctctccgcgtacgtccggccg

SEQ ID NO: 732269 - DNA, 25 bp, Artificial sequence
  Synthetic oligonucleotide
ctaggcgtccggtcctagcgcagcg

SEQ ID NO: 732270 - DNA, 25 bp, Artificial sequence
  Synthetic oligonucleotide
cgctcctacgcgtggtcggaaccgg

SEQ ID NO: 732271 - DNA, 25 bp, Artificial sequence
  Synthetic oligonucleotide
aggcaacgacgttcgtgcgggcccc

SEQ ID NO: 732272 - DNA, 25 bp, Artificial sequence
  Synthetic oligonucleotide
tggaccaccggcccgctagtcacgg

SEQ ID NO: 732273 - DNA, 25 bp, Artificial sequence
  Synthetic oligonucleotide
tggaccaccggcgcgctagtcacgg

SEQ ID NO: 732274 - DNA, 25 bp, Artificial sequence
  Synthetic oligonucleotide
cgccggcgttcgggacgtaagcgca

SEQ ID NO: 732275 - DNA, 25 bp, Artificial sequence
  Synthetic oligonucleotide
cgccggcgttcgcgacgtaagcgca

SEQ ID NO: 732276 - DNA, 25 bp, Artificial sequence
  Synthetic oligonucleotide
cacgtccggactcgtacgccgaggc

SEQ ID NO: 732277 - DNA, 25 bp, Artificial sequence
  Synthetic oligonucleotide
cacgtccggactggtacgccgaggc

SEQ ID NO: 732278 - DNA, 25 bp, Artificial sequence
  Synthetic oligonucleotide
cgcgttggtctatcgcgcgcccgac

SEQ ID NO: 732279 - DNA, 25 bp, Artificial sequence
  Synthetic oligonucleotide
cgcgttggtctaacgcgcgcccgac

SEQ ID NO: 732280 - DNA, 25 bp, Artificial sequence
  Synthetic oligonucleotide
gacgtcgtccgacgcgatgctgcgg

SEQ ID NO: 732281 - DNA, 25 bp, Artificial sequence
  Synthetic oligonucleotide
ctaggcgtccggacctagcgcagcg

SEQ ID NO: 732282 - DNA, 25 bp, Artificial sequence
  Synthetic oligonucleotide
cgcctcggctacggacgaacggagc

SEQ ID NO: 732283 - DNA, 25 bp, Artificial sequence
  Synthetic oligonucleotide
cggccacccgtacggcatagtcccc

SEQ ID NO: 732284 - DNA, 25 bp, Artificial sequence
  Synthetic oligonucleotide
ctcgggtctagggcgcggaccttgc

SEQ ID NO: 732285 - DNA, 25 bp, Artificial sequence
  Synthetic oligonucleotide
ctcgggtctaggccgcggaccttgc

SEQ ID NO: 732286 - DNA, 25 bp, Artificial sequence
  Synthetic oligonucleotide
ccagggcgatacgaccgcgctgcga

SEQ ID NO: 732287 - DNA, 25 bp, Artificial sequence
  Synthetic oligonucleotide
ccagggcgataccaccgcgctgcga

SEQ ID NO: 732288 - DNA, 25 bp, Artificial sequence
  Synthetic oligonucleotide
ggactggcgcggaatccaaccccgc

SEQ ID NO: 732289 - DNA, 25 bp, Artificial sequence
  Synthetic oligonucleotide
ggactggcgcggtatccaaccccgc

SEQ ID NO: 732290 - DNA, 25 bp, Artificial sequence
  Synthetic oligonucleotide
tgcgcggtcgccgataacgcgggag

SEQ ID NO: 732291 - DNA, 25 bp, Artificial sequence
  Synthetic oligonucleotide
tgcgcggtcgcccataacgcgggag

SEQ ID NO: 732292 - DNA, 25 bp, Artificial sequence
  Synthetic oligonucleotide
ggaggcgtaggacggcgcagcaacc

SEQ ID NO: 732293 - DNA, 25 bp, Artificial sequence
  Synthetic oligonucleotide
tggcccattggccggcgtccggatc

SEQ ID NO: 732294 - DNA, 25 bp, Artificial sequence
  Synthetic oligonucleotide
cgcctcggctaccgacgaacggagc

SEQ ID NO: 732295 - DNA, 25 bp, Artificial sequence
  Synthetic oligonucleotide
acgcgccgatactcgtcggccgggt

SEQ ID NO: 732296 - DNA, 25 bp, Artificial sequence
  Synthetic oligonucleotide
ccgcctatgcgacggtccgtgggct

SEQ ID NO: 732297 - DNA, 25 bp, Artificial sequence
  Synthetic oligonucleotide
ccgcctatgcgagggtccgtgggct

SEQ ID NO: 732298 - DNA, 25 bp, Artificial sequence
  Synthetic oligonucleotide
acggcggtcgtgagtcggcggtacc

SEQ ID NO: 732299 - DNA, 25 bp, Artificial sequence
  Synthetic oligonucleotide
acggcggtcgtgtgtcggcggtacc

SEQ ID NO: 732300 - DNA, 25 bp, Artificial sequence
  Synthetic oligonucleotide
gtggcgcgcgcctagacatggccac

SEQ ID NO: 732301 - DNA, 25 bp, Artificial sequence
  Synthetic oligonucleotide
gtggcgcgcgccaagacatggccac

SEQ ID NO: 732302 - DNA, 25 bp, Artificial sequence
  Synthetic oligonucleotide
ccggggcgacccgtgtacgcgatct

SEQ ID NO: 732303 - DNA, 25 bp, Artificial sequence
  Synthetic oligonucleotide
ccggggcgacccctgtacgcgatct

SEQ ID NO: 732304 - DNA, 25 bp, Artificial sequence
  Synthetic oligonucleotide
ccagggcgcaagatacccggcgcga

SEQ ID NO: 732305 - DNA, 25 bp, Artificial sequence
  Synthetic oligonucleotide
ccagggcgcaagttacccggcgcga

SEQ ID NO: 732306 - DNA, 25 bp, Artificial sequence
  Synthetic oligonucleotide
ggaggcgtaggagggcgcagcaacc

SEQ ID NO: 732307 - DNA, 25 bp, Artificial sequence
  Synthetic oligonucleotide
gtgacccgcggtcggatacggccgt

SEQ ID NO: 732308 - DNA, 25 bp, Artificial sequence
  Synthetic oligonucleotide
cgcttgacgggcgagacgtccaggc

SEQ ID NO: 732309 - DNA, 25 bp, Artificial sequence
  Synthetic oligonucleotide
cccctggcgttagggctcgtcggac

SEQ ID NO: 732310 - DNA, 25 bp, Artificial sequence
  Synthetic oligonucleotide
cctggggcgtcgggttaggccacgt

SEQ ID NO: 732311 - DNA, 25 bp, Artificial sequence
  Synthetic oligonucleotide
agccgaggtacggccggatgaccgc

SEQ ID NO: 732312 - DNA, 25 bp, Artificial sequence
  Synthetic oligonucleotide
agccgaggtacgcccggatgaccgc

SEQ ID NO: 732313 - DNA, 25 bp, Artificial sequence
  Synthetic oligonucleotide
cggccgccgaacatgcgcgctcaag

SEQ ID NO: 732314 - DNA, 25 bp, Artificial sequence
  Synthetic oligonucleotide
cggccgccgaacttgcgcgctcaag

SEQ ID NO: 732315 - DNA, 25 bp, Artificial sequence
  Synthetic oligonucleotide
tgcgggacgacggagcgtactcccc

SEQ ID NO: 732316 - DNA, 25 bp, Artificial sequence
  Synthetic oligonucleotide
tgcgggacgacgcagcgtactcccc

SEQ ID NO: 732317 - DNA, 25 bp, Artificial sequence
  Synthetic oligonucleotide
ggggacaggcgccttacggctgcag

SEQ ID NO: 732318 - DNA, 25 bp, Artificial sequence
  Synthetic oligonucleotide
cggccacccgtagggcatagtcccc

SEQ ID NO: 732319 - DNA, 25 bp, Artificial sequence
  Synthetic oligonucleotide
gtgacccgcggtgggatacggccgt

SEQ ID NO: 732320 - DNA, 25 bp, Artificial sequence
  Synthetic oligonucleotide
acgcgccgatacacgtcggccgggt

SEQ ID NO: 732321 - DNA, 25 bp, Artificial sequence
  Synthetic oligonucleotide
caggtctagtacggtcgccgccccg

SEQ ID NO: 732322 - DNA, 25 bp, Artificial sequence
  Synthetic oligonucleotide
caggtctagtaccgtcgccgccccg

SEQ ID NO: 732323 - DNA, 25 bp, Artificial sequence
  Synthetic oligonucleotide
gggagcgcgaccccgattgcacagg

SEQ ID NO: 732324 - DNA, 25 bp, Artificial sequence
  Synthetic oligonucleotide
gggagcgcgaccgcgattgcacagg

SEQ ID NO: 732325 - DNA, 25 bp, Artificial sequence
  Synthetic oligonucleotide
tccccgagacgcccggtcgtcagag

SEQ ID NO: 732326 - DNA, 25 bp, Artificial sequence
  Synthetic oligonucleotide
tccccgagacgcgcggtcgtcagag

SEQ ID NO: 732327 - DNA, 25 bp, Artificial sequence
  Synthetic oligonucleotide
gttccctagcgcctacgctccgccc

SEQ ID NO: 732328 - DNA, 25 bp, Artificial sequence
  Synthetic oligonucleotide
gttccctagcgcgtacgctccgccc

SEQ ID NO: 732329 - DNA, 25 bp, Artificial sequence
  Synthetic oligonucleotide
cccagcgtacgcgacgacctggtcc

SEQ ID NO: 732330 - DNA, 25 bp, Artificial sequence
  Synthetic oligonucleotide
cccagcgtacgccacgacctggtcc

SEQ ID NO: 732331 - DNA, 25 bp, Artificial sequence
  Synthetic oligonucleotide
cccctggcgttacggctcgtcggac

SEQ ID NO: 732332 - DNA, 25 bp, Artificial sequence
  Synthetic oligonucleotide
ggggacaggcgcgttacggctgcag

SEQ ID NO: 732333 - DNA, 25 bp, Artificial sequence
  Synthetic oligonucleotide
ggggctgtcgactcgacccagtccg

SEQ ID NO: 732334 - DNA, 25 bp, Artificial sequence
  Synthetic oligonucleotide
cgcgcggcgcggacttacgtatccc

SEQ ID NO: 732335 - DNA, 25 bp, Artificial sequence
  Synthetic oligonucleotide
gagcccccgcggacgtagaccgctt

SEQ ID NO: 732336 - DNA, 25 bp, Artificial sequence
  Synthetic oligonucleotide
gagcccccgcggtcgtagaccgctt

SEQ ID NO: 732337 - DNA, 25 bp, Artificial sequence
  Synthetic oligonucleotide
caacggcgtgcgacgtaggctcggg

SEQ ID NO: 732338 - DNA, 25 bp, Artificial sequence
  Synthetic oligonucleotide
caacggcgtgcgtcgtaggctcggg

SEQ ID NO: 732339 - DNA, 25 bp, Artificial sequence
  Synthetic oligonucleotide
cggtcctaatcgtggcgcggcccgt

SEQ ID NO: 732340 - DNA, 25 bp, Artificial sequence
  Synthetic oligonucleotide
cggtcctaatcgaggcgcggcccgt

SEQ ID NO: 732341 - DNA, 25 bp, Artificial sequence
  Synthetic oligonucleotide
accgctgatacgcgcgggacccagg

SEQ ID NO: 732342 - DNA, 25 bp, Artificial sequence
  Synthetic oligonucleotide
accgctgatacgggcgggacccagg

SEQ ID NO: 732343 - DNA, 25 bp, Artificial sequence
  Synthetic oligonucleotide
ccgcacccgcgttgacgtacagccg

SEQ ID NO: 732344 - DNA, 25 bp, Artificial sequence
  Synthetic oligonucleotide
cgcgcggcgcggtcttacgtatccc

SEQ ID NO: 732345 - DNA, 25 bp, Artificial sequence
  Synthetic oligonucleotide
ggggctgtcgacacgacccagtccg

SEQ ID NO: 732346 - DNA, 25 bp, Artificial sequence
  Synthetic oligonucleotide
tccagccgcggtaagctcgcacgcc

SEQ ID NO: 732347 - DNA, 25 bp, Artificial sequence
  Synthetic oligonucleotide
gcgagatagggcggcaacggccggt

SEQ ID NO: 732348 - DNA, 25 bp, Artificial sequence
  Synthetic oligonucleotide
gcgagatagggccgcaacggccggt

SEQ ID NO: 732349 - DNA, 25 bp, Artificial sequence
  Synthetic oligonucleotide
cggctagttgacccgaggtggcccg

SEQ ID NO: 732350 - DNA, 25 bp, Artificial sequence
  Synthetic oligonucleotide
cggctagttgacgcgaggtggcccg

SEQ ID NO: 732351 - DNA, 25 bp, Artificial sequence
  Synthetic oligonucleotide
gccagccgtcgcggagctagtcgct

SEQ ID NO: 732352 - DNA, 25 bp, Artificial sequence
  Synthetic oligonucleotide
gccagccgtcgccgagctagtcgct

SEQ ID NO: 732353 - DNA, 25 bp, Artificial sequence
  Synthetic oligonucleotide
caccgcacgtgccgctatctggccc

SEQ ID NO: 732354 - DNA, 25 bp, Artificial sequence
  Synthetic oligonucleotide
caccgcacgtgcggctatctggccc

SEQ ID NO: 732355 - DNA, 25 bp, Artificial sequence
  Synthetic oligonucleotide
tccagccgcggttagctcgcacgcc

SEQ ID NO: 732356 - DNA, 25 bp, Artificial sequence
  Synthetic oligonucleotide
gtcggcgtaacggccgaccctcgac

SEQ ID NO: 732357 - DNA, 25 bp, Artificial sequence
  Synthetic oligonucleotide
ccgcacccgcgtagacgtacagccg

SEQ ID NO: 732358 - DNA, 25 bp, Artificial sequence
  Synthetic oligonucleotide
acgcggatcgcgtaggcggggcagt

SEQ ID NO: 732359 - DNA, 25 bp, Artificial sequence
  Synthetic oligonucleotide
accgcgcgggccgtagtaagcctgg

SEQ ID NO: 732360 - DNA, 25 bp, Artificial sequence
  Synthetic oligonucleotide
gtcggcgtaacgcccgaccctcgac

SEQ ID NO: 732361 - DNA, 25 bp, Artificial sequence
  Synthetic oligonucleotide
cgctgggagcgttcgcgactctcgc

SEQ ID NO: 732362 - DNA, 25 bp, Artificial sequence
  Synthetic oligonucleotide
cgctgggagcgtacgcgactctcgc

SEQ ID NO: 732363 - DNA, 25 bp, Artificial sequence
  Synthetic oligonucleotide
gagcaccccgatggtacgggacgcg

SEQ ID NO: 732364 - DNA, 25 bp, Artificial sequence
  Synthetic oligonucleotide
acgcggatcgcgaaggcggggcagt

SEQ ID NO: 732365 - DNA, 25 bp, Artificial sequence
  Synthetic oligonucleotide
tggcccattggcgggcgtccggatc

SEQ ID NO: 732366 - DNA, 25 bp, Artificial sequence
  Synthetic oligonucleotide
cggaggcccgtatcgcgcatgctgg

SEQ ID NO: 732367 - DNA, 25 bp, Artificial sequence
  Synthetic oligonucleotide
cggaggcccgtaacgcgcatgctgg

SEQ ID NO: 732368 - DNA, 25 bp, Artificial sequence
  Synthetic oligonucleotide
gggcgctgtaggggcgctagtctgc

SEQ ID NO: 732369 - DNA, 25 bp, Artificial sequence
  Synthetic oligonucleotide
gggcgctgtaggcgcgctagtctgc

SEQ ID NO: 732370 - DNA, 25 bp, Artificial sequence
  Synthetic oligonucleotide
ccccgttatcgcgctccgagcccgt

SEQ ID NO: 732371 - DNA, 25 bp, Artificial sequence
  Synthetic oligonucleotide
ggccggtatgcggattcgcgtcccg

SEQ ID NO: 732372 - DNA, 25 bp, Artificial sequence
  Synthetic oligonucleotide
gagcaccccgatcgtacgggacgcg

SEQ ID NO: 732373 - DNA, 25 bp, Artificial sequence
  Synthetic oligonucleotide
cgtacggcgcgttaccgaccgagcc

SEQ ID NO: 732374 - DNA, 25 bp, Artificial sequence
  Synthetic oligonucleotide
ccccgttatcgccctccgagcccgt

SEQ ID NO: 732375 - DNA, 25 bp, Artificial sequence
  Synthetic oligonucleotide
accgcgcgggccctagtaagcctgg

SEQ ID NO: 732376 - DNA, 25 bp, Artificial sequence
  Synthetic oligonucleotide
agggcggactactcgcgatgccggc

SEQ ID NO: 732377 - DNA, 25 bp, Artificial sequence
  Synthetic oligonucleotide
agggcggactacacgcgatgccggc

SEQ ID NO: 732378 - DNA, 25 bp, Artificial sequence
  Synthetic oligonucleotide
cggcgcgctacgcgggtattcccac

SEQ ID NO: 732379 - DNA, 25 bp, Artificial sequence
  Synthetic oligonucleotide
cggcgcgctacgggggtattcccac

SEQ ID NO: 732380 - DNA, 25 bp, Artificial sequence
  Synthetic oligonucleotide
cgtacggcgcgtaaccgaccgagcc

SEQ ID NO: 732381 - DNA, 25 bp, Artificial sequence
  Synthetic oligonucleotide
ggccggtatgcgcattcgcgtcccg

SEQ ID NO: 732382 - DNA, 25 bp, Artificial sequence
  Synthetic oligonucleotide
gccaggggtaccctcgagcccgacc

SEQ ID NO: 732383 - DNA, 25 bp, Artificial sequence
  Synthetic oligonucleotide
agggcctcggtccactcgcgccagc

SEQ ID NO: 732384 - DNA, 25 bp, Artificial sequence
  Synthetic oligonucleotide
cctggccacggcttcgcgacggcga

SEQ ID NO: 732385 - DNA, 25 bp, Artificial sequence
  Synthetic oligonucleotide
agggcctcggtcgactcgcgccagc

SEQ ID NO: 732386 - DNA, 25 bp, Artificial sequence
  Synthetic oligonucleotide
cctgccccccgtacgtcgcagagcc

SEQ ID NO: 732387 - DNA, 25 bp, Artificial sequence
  Synthetic oligonucleotide
cctgccccccgttcgtcgcagagcc

SEQ ID NO: 732388 - DNA, 25 bp, Artificial sequence
  Synthetic oligonucleotide
tgctggcgctcgcgttacggccgcg

SEQ ID NO: 732389 - DNA, 25 bp, Artificial sequence
  Synthetic oligonucleotide
tgctggcgctcgggttacggccgcg

SEQ ID NO: 732390 - DNA, 25 bp, Artificial sequence
  Synthetic oligonucleotide
cgtgcgtccgcgacgttcggcggct

SEQ ID NO: 732391 - DNA, 25 bp, Artificial sequence
  Synthetic oligonucleotide
cctggccacggcatcgcgacggcga

SEQ ID NO: 732392 - DNA, 25 bp, Artificial sequence
  Synthetic oligonucleotide
cgtgcgtccgcgtcgttcggcggct

SEQ ID NO: 732393 - DNA, 25 bp, Artificial sequence
  Synthetic oligonucleotide
ttcggcgcgtacgtctcggcggccc

SEQ ID NO: 732394 - DNA, 25 bp, Artificial sequence
  Synthetic oligonucleotide
ttcggcgcgtacctctcggcggccc

SEQ ID NO: 732395 - DNA, 25 bp, Artificial sequence
  Synthetic oligonucleotide
acctgcccccgtttcgccggcgcag

SEQ ID NO: 732396 - DNA, 25 bp, Artificial sequence
  Synthetic oligonucleotide
acctgcccccgtatcgccggcgcag

SEQ ID NO: 732397 - DNA, 25 bp, Artificial sequence
  Synthetic oligonucleotide
gaggacccggcggtagtcgccaccc

SEQ ID NO: 732398 - DNA, 25 bp, Artificial sequence
  Synthetic oligonucleotide
gaggacccggcgctagtcgccaccc

SEQ ID NO: 732399 - DNA, 25 bp, Artificial sequence
  Synthetic oligonucleotide
gggccgcggcgcacgctaactcgct

SEQ ID NO: 732400 - DNA, 25 bp, Artificial sequence
  Synthetic oligonucleotide
gggccgcggcgctcgctaactcgct

SEQ ID NO: 732401 - DNA, 25 bp, Artificial sequence
  Synthetic oligonucleotide
acggtgctaaccggcgcgtcgccgc

SEQ ID NO: 732402 - DNA, 25 bp, Artificial sequence
  Synthetic oligonucleotide
gccaggggtaccgtcgagcccgacc

SEQ ID NO: 732403 - DNA, 25 bp, Artificial sequence
  Synthetic oligonucleotide
gcacggagcgcggactacgcgggac

SEQ ID NO: 732404 - DNA, 25 bp, Artificial sequence
  Synthetic oligonucleotide
caccgtcgtgcgcgatagggggggg

SEQ ID NO: 732405 - DNA, 25 bp, Artificial sequence
  Synthetic oligonucleotide
gcacggagcgcgcactacgcgggac

SEQ ID NO: 732406 - DNA, 25 bp, Artificial sequence
  Synthetic oligonucleotide
acggtgctaacccgcgcgtcgccgc

SEQ ID NO: 732407 - DNA, 25 bp, Artificial sequence
  Synthetic oligonucleotide
caccgtcgtgcgggatagggggggg

SEQ ID NO: 732408 - DNA, 25 bp, Artificial sequence
  Synthetic oligonucleotide
ggcgtgtacccggcgcgatgccgtg

SEQ ID NO: 732409 - DNA, 25 bp, Artificial sequence
  Synthetic oligonucleotide
ctcgggccggacgcgctatcgggac

SEQ ID NO: 732410 - DNA, 25 bp, Artificial sequence
  Synthetic oligonucleotide
gcggcgggtacccatacgccagcgg

SEQ ID NO: 732411 - DNA, 25 bp, Artificial sequence
  Synthetic oligonucleotide
ggcgtgtacccgccgcgatgccgtg

SEQ ID NO: 732412 - DNA, 25 bp, Artificial sequence
  Synthetic oligonucleotide
tcggtgccaggcgtacgacccccgg

SEQ ID NO: 732413 - DNA, 25 bp, Artificial sequence
  Synthetic oligonucleotide
tcggtgccaggcctacgacccccgg

SEQ ID NO: 732414 - DNA, 25 bp, Artificial sequence
  Synthetic oligonucleotide
tcgggagttcgaccgcgcgggtcgc

SEQ ID NO: 732415 - DNA, 25 bp, Artificial sequence
  Synthetic oligonucleotide
tcgggagttcgagcgcgcgggtcgc

SEQ ID NO: 732416 - DNA, 25 bp, Artificial sequence
  Synthetic oligonucleotide
cgggagcgcgattgaacgcgcggcc

SEQ ID NO: 732417 - DNA, 25 bp, Artificial sequence
  Synthetic oligonucleotide
cgggagcgcgatagaacgcgcggcc

SEQ ID NO: 732418 - DNA, 25 bp, Artificial sequence
  Synthetic oligonucleotide
cgccggccgtacccgtctggtgcca

SEQ ID NO: 732419 - DNA, 25 bp, Artificial sequence
  Synthetic oligonucleotide
cccgagcgagtagccgcgaccctcg

SEQ ID NO: 732420 - DNA, 25 bp, Artificial sequence
  Synthetic oligonucleotide
cccgggtctcgaggtgcgacgtgcg

SEQ ID NO: 732421 - DNA, 25 bp, Artificial sequence
  Synthetic oligonucleotide
cgccggccgtacgcgtctggtgcca

SEQ ID NO: 732422 - DNA, 25 bp, Artificial sequence
  Synthetic oligonucleotide
gcatgcggcgtccaacgctcgggcc

SEQ ID NO: 732423 - DNA, 25 bp, Artificial sequence
  Synthetic oligonucleotide
gcatgcggcgtcgaacgctcgggcc

SEQ ID NO: 732424 - DNA, 25 bp, Artificial sequence
  Synthetic oligonucleotide
ccccgcctgcgacgcacgaccgaag

SEQ ID NO: 732425 - DNA, 25 bp, Artificial sequence
  Synthetic oligonucleotide
ccccgcctgcgaggcacgaccgaag

SEQ ID NO: 732426 - DNA, 25 bp, Artificial sequence
  Synthetic oligonucleotide
cggacgcggtcggtacggaccctgc

SEQ ID NO: 732427 - DNA, 25 bp, Artificial sequence
  Synthetic oligonucleotide
cggacgcggtcgctacggaccctgc

SEQ ID NO: 732428 - DNA, 25 bp, Artificial sequence
  Synthetic oligonucleotide
ccgggtcccggttcgtcgcagctgg

SEQ ID NO: 732429 - DNA, 25 bp, Artificial sequence
  Synthetic oligonucleotide
ccgggtcccggtacgtcgcagctgg

SEQ ID NO: 732430 - DNA, 25 bp, Artificial sequence
  Synthetic oligonucleotide
cccgggtctcgacgtgcgacgtgcg

SEQ ID NO: 732431 - DNA, 25 bp, Artificial sequence
  Synthetic oligonucleotide
cccgagcgagtacccgcgaccctcg

SEQ ID NO: 732432 - DNA, 25 bp, Artificial sequence
  Synthetic oligonucleotide
cagctcgccgggtacgcgtgtgcgg

SEQ ID NO: 732433 - DNA, 25 bp, Artificial sequence
  Synthetic oligonucleotide
tcgaggcgacgcgaagcgctccccc

SEQ ID NO: 732434 - DNA, 25 bp, Artificial sequence
  Synthetic oligonucleotide
cccaatgcgaccccctacgccgggc

SEQ ID NO: 732435 - DNA, 25 bp, Artificial sequence
  Synthetic oligonucleotide
cccaatgcgaccgcctacgccgggc

SEQ ID NO: 732436 - DNA, 25 bp, Artificial sequence
  Synthetic oligonucleotide
cgctcgctacgaccggtgccagggc

SEQ ID NO: 732437 - DNA, 25 bp, Artificial sequence
  Synthetic oligonucleotide
cgctcgctacgagcggtgccagggc

SEQ ID NO: 732438 - DNA, 25 bp, Artificial sequence
  Synthetic oligonucleotide
cccagcgcgtgcggctcgttagggc

SEQ ID NO: 732439 - DNA, 25 bp, Artificial sequence
  Synthetic oligonucleotide
cccagcgcgtgccgctcgttagggc

SEQ ID NO: 732440 - DNA, 25 bp, Artificial sequence
  Synthetic oligonucleotide
cccccggcgtatgccctcgcgctac

SEQ ID NO: 732441 - DNA, 25 bp, Artificial sequence
  Synthetic oligonucleotide
cccccggcgtatcccctcgcgctac

SEQ ID NO: 732442 - DNA, 25 bp, Artificial sequence
  Synthetic oligonucleotide
gggcgctcgtccccgaacctcggag

SEQ ID NO: 732443 - DNA, 25 bp, Artificial sequence
  Synthetic oligonucleotide
agggccatcggtagcgcgcggtcgg

SEQ ID NO: 732444 - DNA, 25 bp, Artificial sequence
  Synthetic oligonucleotide
cagctcgccgggaacgcgtgtgcgg

SEQ ID NO: 732445 - DNA, 25 bp, Artificial sequence
  Synthetic oligonucleotide
tcgaggcgacgccaagcgctccccc

SEQ ID NO: 732446 - DNA, 25 bp, Artificial sequence
  Synthetic oligonucleotide
tgcccggctagcccgacgcgacggt

SEQ ID NO: 732447 - DNA, 25 bp, Artificial sequence
  Synthetic oligonucleotide
tgcccggctagcgcgacgcgacggt

SEQ ID NO: 732448 - DNA, 25 bp, Artificial sequence
  Synthetic oligonucleotide
gcagctgtcggagtagcggcccccc

SEQ ID NO: 732449 - DNA, 25 bp, Artificial sequence
  Synthetic oligonucleotide
gcagctgtcggactagcggcccccc

SEQ ID NO: 732450 - DNA, 25 bp, Artificial sequence
  Synthetic oligonucleotide
ccgggcggcgtaaaggcgccatgcg

SEQ ID NO: 732451 - DNA, 25 bp, Artificial sequence
  Synthetic oligonucleotide
ccgggcggcgtataggcgccatgcg

SEQ ID NO: 732452 - DNA, 25 bp, Artificial sequence
  Synthetic oligonucleotide
ggcgacggtccgacgtacgtggcgc

SEQ ID NO: 732453 - DNA, 25 bp, Artificial sequence
  Synthetic oligonucleotide
ggcgacggtccgtcgtacgtggcgc

SEQ ID NO: 732454 - DNA, 25 bp, Artificial sequence
  Synthetic oligonucleotide
caggcgccgttaacgcccggtgccc

SEQ ID NO: 732455 - DNA, 25 bp, Artificial sequence
  Synthetic oligonucleotide
cggttgcccgaacttcgcggccgcc

SEQ ID NO: 732456 - DNA, 25 bp, Artificial sequence
  Synthetic oligonucleotide
gggcgctcgtccgcgaacctcggag

SEQ ID NO: 732457 - DNA, 25 bp, Artificial sequence
  Synthetic oligonucleotide
agctcgtcgtgacgcggccggaggc

SEQ ID NO: 732458 - DNA, 25 bp, Artificial sequence
  Synthetic oligonucleotide
gcgcgcacccccgtcggacggcatt

SEQ ID NO: 732459 - DNA, 25 bp, Artificial sequence
  Synthetic oligonucleotide
gcgcgcacccccctcggacggcatt

SEQ ID NO: 732460 - DNA, 25 bp, Artificial sequence
  Synthetic oligonucleotide
ccccgctgtatcccgcgaggccgag

SEQ ID NO: 732461 - DNA, 25 bp, Artificial sequence
  Synthetic oligonucleotide
ccccgctgtatcgcgcgaggccgag

SEQ ID NO: 732462 - DNA, 25 bp, Artificial sequence
  Synthetic oligonucleotide
cgacgccgacgcgctaccggtccac

SEQ ID NO: 732463 - DNA, 25 bp, Artificial sequence
  Synthetic oligonucleotide
cgacgccgacgccctaccggtccac

SEQ ID NO: 732464 - DNA, 25 bp, Artificial sequence
  Synthetic oligonucleotide
gcggggcgcgaacgcatggtacgcg

SEQ ID NO: 732465 - DNA, 25 bp, Artificial sequence
  Synthetic oligonucleotide
gcggggcgcgaaggcatggtacgcg

SEQ ID NO: 732466 - DNA, 25 bp, Artificial sequence
  Synthetic oligonucleotide
gaaggccgtacgcacccgcgctggc

SEQ ID NO: 732467 - DNA, 25 bp, Artificial sequence
  Synthetic oligonucleotide
gaaggccgtacggacccgcgctggc

SEQ ID NO: 732468 - DNA, 25 bp, Artificial sequence
  Synthetic oligonucleotide
ctcgggccggacccgctatcgggac

SEQ ID NO: 732469 - DNA, 25 bp, Artificial sequence
  Synthetic oligonucleotide
cgcggccccataacggccgatccgg

SEQ ID NO: 732470 - DNA, 25 bp, Artificial sequence
  Synthetic oligonucleotide
gcggcgggtaccgatacgccagcgg

SEQ ID NO: 732471 - DNA, 25 bp, Artificial sequence
  Synthetic oligonucleotide
agctcgtcgtgaggcggccggaggc

SEQ ID NO: 732472 - DNA, 25 bp, Artificial sequence
  Synthetic oligonucleotide
cggcgtactatcccgggggccaccc

SEQ ID NO: 732473 - DNA, 25 bp, Artificial sequence
  Synthetic oligonucleotide
cggcgtactatcgcgggggccaccc

SEQ ID NO: 732474 - DNA, 25 bp, Artificial sequence
  Synthetic oligonucleotide
ctcgcctcgcccggctacacgggtc

SEQ ID NO: 732475 - DNA, 25 bp, Artificial sequence
  Synthetic oligonucleotide
ctcgcctcgccccgctacacgggtc

SEQ ID NO: 732476 - DNA, 25 bp, Artificial sequence
  Synthetic oligonucleotide
ccgctcgacgggacgcgcatgcctg

SEQ ID NO: 732477 - DNA, 25 bp, Artificial sequence
  Synthetic oligonucleotide
ccgctcgacgggtcgcgcatgcctg

SEQ ID NO: 732478 - DNA, 25 bp, Artificial sequence
  Synthetic oligonucleotide
ggtcggcgtaagtcgcgacgcggcc

SEQ ID NO: 732479 - DNA, 25 bp, Artificial sequence
  Synthetic oligonucleotide
ggtcggcgtaagacgcgacgcggcc

SEQ ID NO: 732480 - DNA, 25 bp, Artificial sequence
  Synthetic oligonucleotide
caggcgccgttatcgcccggtgccc

SEQ ID NO: 732481 - DNA, 25 bp, Artificial sequence
  Synthetic oligonucleotide
cgcggccccatatcggccgatccgg

SEQ ID NO: 732482 - DNA, 25 bp, Artificial sequence
  Synthetic oligonucleotide
gcgggggatcgttcacgcggcggtc

SEQ ID NO: 732483 - DNA, 25 bp, Artificial sequence
  Synthetic oligonucleotide
cagcagctaccgcggtcggccgtgc

SEQ ID NO: 732484 - DNA, 25 bp, Artificial sequence
  Synthetic oligonucleotide
ggcccacgtggttcgtcgcggccgt

SEQ ID NO: 732485 - DNA, 25 bp, Artificial sequence
  Synthetic oligonucleotide
cgcccggtcgtaggccccgcgagta

SEQ ID NO: 732486 - DNA, 25 bp, Artificial sequence
  Synthetic oligonucleotide
ggcacgcggccggtaaccgcgttcg

SEQ ID NO: 732487 - DNA, 25 bp, Artificial sequence
  Synthetic oligonucleotide
cgcccggtcgtacgccccgcgagta

SEQ ID NO: 732488 - DNA, 25 bp, Artificial sequence
  Synthetic oligonucleotide
gggggaggaccgttgcgtcacgcgg

SEQ ID NO: 732489 - DNA, 25 bp, Artificial sequence
  Synthetic oligonucleotide
gggggaggaccgatgcgtcacgcgg

SEQ ID NO: 732490 - DNA, 25 bp, Artificial sequence
  Synthetic oligonucleotide
ccgctctgcggtttccggcgcacgg

SEQ ID NO: 732491 - DNA, 25 bp, Artificial sequence
  Synthetic oligonucleotide
ccgctctgcggtatccggcgcacgg

SEQ ID NO: 732492 - DNA, 25 bp, Artificial sequence
  Synthetic oligonucleotide
cgcggcacgccgttacgcaggcctc

SEQ ID NO: 732493 - DNA, 25 bp, Artificial sequence
  Synthetic oligonucleotide
gcggtagaccgggcgtacgcgggtc

SEQ ID NO: 732494 - DNA, 25 bp, Artificial sequence
  Synthetic oligonucleotide
gcgggggatcgtacacgcggcggtc

SEQ ID NO: 732495 - DNA, 25 bp, Artificial sequence
  Synthetic oligonucleotide
gctggagatagccccgcgcgacccc

SEQ ID NO: 732496 - DNA, 25 bp, Artificial sequence
  Synthetic oligonucleotide
cgagccacggagggtcgaccagggg

SEQ ID NO: 732497 - DNA, 25 bp, Artificial sequence
  Synthetic oligonucleotide
cgagccacggagcgtcgaccagggg

SEQ ID NO: 732498 - DNA, 25 bp, Artificial sequence
  Synthetic oligonucleotide
accccagcgcgagacggtacgcggg

SEQ ID NO: 732499 - DNA, 25 bp, Artificial sequence
  Synthetic oligonucleotide
accccagcgcgacacggtacgcggg

SEQ ID NO: 732500 - DNA, 25 bp, Artificial sequence
  Synthetic oligonucleotide
gcggcgacgcgccgttaggcccact

SEQ ID NO: 732501 - DNA, 25 bp, Artificial sequence
  Synthetic oligonucleotide
gcggcgacgcgcggttaggcccact

SEQ ID NO: 732502 - DNA, 25 bp, Artificial sequence
  Synthetic oligonucleotide
cgggagccgagttcgtcgcctgcgc

SEQ ID NO: 732503 - DNA, 25 bp, Artificial sequence
  Synthetic oligonucleotide
cgggagccgagtacgtcgcctgcgc

SEQ ID NO: 732504 - DNA, 25 bp, Artificial sequence
  Synthetic oligonucleotide
gcgggcatccgcctagctcgacggg

SEQ ID NO: 732505 - DNA, 25 bp, Artificial sequence
  Synthetic oligonucleotide
gggctaacctcgcgtcgggcgtccg

SEQ ID NO: 732506 - DNA, 25 bp, Artificial sequence
  Synthetic oligonucleotide
cgcggcacgccgatacgcaggcctc

SEQ ID NO: 732507 - DNA, 25 bp, Artificial sequence
  Synthetic oligonucleotide
cggcactagttcccgaccggcgcgc

SEQ ID NO: 732508 - DNA, 25 bp, Artificial sequence
  Synthetic oligonucleotide
ggcacgcggccgctaaccgcgttcg

SEQ ID NO: 732509 - DNA, 25 bp, Artificial sequence
  Synthetic oligonucleotide
gggctaacctcgggtcgggcgtccg

SEQ ID NO: 732510 - DNA, 25 bp, Artificial sequence
  Synthetic oligonucleotide
ccgccgccgcgctagtacgccggat

SEQ ID NO: 732511 - DNA, 25 bp, Artificial sequence
  Synthetic oligonucleotide
ccgccgccgcgcaagtacgccggat

SEQ ID NO: 732512 - DNA, 25 bp, Artificial sequence
  Synthetic oligonucleotide
cgcgcggcacgaccgcgaatggtgc

SEQ ID NO: 732513 - DNA, 25 bp, Artificial sequence
  Synthetic oligonucleotide
cgcgcggcacgagcgcgaatggtgc

SEQ ID NO: 732514 - DNA, 25 bp, Artificial sequence
  Synthetic oligonucleotide
gcgcttgtagcgcgcaacgggccgg

SEQ ID NO: 732515 - DNA, 25 bp, Artificial sequence
  Synthetic oligonucleotide
gcgcttgtagcgggcaacgggccgg

SEQ ID NO: 732516 - DNA, 25 bp, Artificial sequence
  Synthetic oligonucleotide
gcgcggctaactgcgtcggcggacc

SEQ ID NO: 732517 - DNA, 25 bp, Artificial sequence
  Synthetic oligonucleotide
gcgcggctaactccgtcggcggacc

SEQ ID NO: 732518 - DNA, 25 bp, Artificial sequence
  Synthetic oligonucleotide
gcggtagaccggccgtacgcgggtc

SEQ ID NO: 732519 - DNA, 25 bp, Artificial sequence
  Synthetic oligonucleotide
cacgcccgggtaaacggccgcccga

SEQ ID NO: 732520 - DNA, 25 bp, Artificial sequence
  Synthetic oligonucleotide
cagcagctaccggggtcggccgtgc

SEQ ID NO: 732521 - DNA, 25 bp, Artificial sequence
  Synthetic oligonucleotide
cggcactagttcgcgaccggcgcgc

SEQ ID NO: 732522 - DNA, 25 bp, Artificial sequence
  Synthetic oligonucleotide
gcctacgcgtgccgaccgagccagc

SEQ ID NO: 732523 - DNA, 25 bp, Artificial sequence
  Synthetic oligonucleotide
gcctacgcgtgcggaccgagccagc

SEQ ID NO: 732524 - DNA, 25 bp, Artificial sequence
  Synthetic oligonucleotide
gcactgggtcggtcccgacggcgac

SEQ ID NO: 732525 - DNA, 25 bp, Artificial sequence
  Synthetic oligonucleotide
gcactgggtcggacccgacggcgac

SEQ ID NO: 732526 - DNA, 25 bp, Artificial sequence
  Synthetic oligonucleotide
ccccgccaactacgtcgcgccaggg

SEQ ID NO: 732527 - DNA, 25 bp, Artificial sequence
  Synthetic oligonucleotide
ccccgccaactaggtcgcgccaggg

SEQ ID NO: 732528 - DNA, 25 bp, Artificial sequence
  Synthetic oligonucleotide
cgcgcgctaacccgtccgatggccg

SEQ ID NO: 732529 - DNA, 25 bp, Artificial sequence
  Synthetic oligonucleotide
cgcgcgctaaccggtccgatggccg

SEQ ID NO: 732530 - DNA, 25 bp, Artificial sequence
  Synthetic oligonucleotide
gctggagatagcgccgcgcgacccc

SEQ ID NO: 732531 - DNA, 25 bp, Artificial sequence
  Synthetic oligonucleotide
cacgcccgggtatacggccgcccga

SEQ ID NO: 732532 - DNA, 25 bp, Artificial sequence
  Synthetic oligonucleotide
acgggcgtcggccgatacggcgcgt

SEQ ID NO: 732533 - DNA, 25 bp, Artificial sequence
  Synthetic oligonucleotide
gcgggcatccgcgtagctcgacggg

SEQ ID NO: 732534 - DNA, 25 bp, Artificial sequence
  Synthetic oligonucleotide
gcgccgcgcggtgcgatagtccgca

SEQ ID NO: 732535 - DNA, 25 bp, Artificial sequence
  Synthetic oligonucleotide
gcgccgcgcggtccgatagtccgca

SEQ ID NO: 732536 - DNA, 25 bp, Artificial sequence
  Synthetic oligonucleotide
ccgcctccgtcgcgagcttagggcc

SEQ ID NO: 732537 - DNA, 25 bp, Artificial sequence
  Synthetic oligonucleotide
ccgcctccgtcgggagcttagggcc

SEQ ID NO: 732538 - DNA, 25 bp, Artificial sequence
  Synthetic oligonucleotide
tgccgccgggtgcgatacggacgcg

SEQ ID NO: 732539 - DNA, 25 bp, Artificial sequence
  Synthetic oligonucleotide
tgccgccgggtgggatacggacgcg

SEQ ID NO: 732540 - DNA, 25 bp, Artificial sequence
  Synthetic oligonucleotide
tgccacggtcgcaaccggagcgcgg

SEQ ID NO: 732541 - DNA, 25 bp, Artificial sequence
  Synthetic oligonucleotide
tgccacggtcgctaccggagcgcgg

SEQ ID NO: 732542 - DNA, 25 bp, Artificial sequence
  Synthetic oligonucleotide
tcacgctgatcggggtccgcccccc

SEQ ID NO: 732543 - DNA, 25 bp, Artificial sequence
  Synthetic oligonucleotide
gcacgctacggaccggcgtctccgg

SEQ ID NO: 732544 - DNA, 25 bp, Artificial sequence
  Synthetic oligonucleotide
acgggcgtcggcggatacggcgcgt

SEQ ID NO: 732545 - DNA, 25 bp, Artificial sequence
  Synthetic oligonucleotide
ggggacgcgtcgggtacagcggcca

SEQ ID NO: 732546 - DNA, 25 bp, Artificial sequence
  Synthetic oligonucleotide
gggccgccgtcgtacgacctgaccc

SEQ ID NO: 732547 - DNA, 25 bp, Artificial sequence
  Synthetic oligonucleotide
gggccgccgtcgaacgacctgaccc

SEQ ID NO: 732548 - DNA, 25 bp, Artificial sequence
  Synthetic oligonucleotide
ggggcgggcggcctatcgtggtctg

SEQ ID NO: 732549 - DNA, 25 bp, Artificial sequence
  Synthetic oligonucleotide
ggggcgggcggcgtatcgtggtctg

SEQ ID NO: 732550 - DNA, 25 bp, Artificial sequence
  Synthetic oligonucleotide
gcccgcacgcgtagcgggactgagg

SEQ ID NO: 732551 - DNA, 25 bp, Artificial sequence
  Synthetic oligonucleotide
gcccgcacgcgttgcgggactgagg

SEQ ID NO: 732552 - DNA, 25 bp, Artificial sequence
  Synthetic oligonucleotide
cccaccgggcatacgcgacccgagc

SEQ ID NO: 732553 - DNA, 25 bp, Artificial sequence
  Synthetic oligonucleotide
cccaccgggcattcgcgacccgagc

SEQ ID NO: 732554 - DNA, 25 bp, Artificial sequence
  Synthetic oligonucleotide
agcgggcgcgcggactatgcggcga

SEQ ID NO: 732555 - DNA, 25 bp, Artificial sequence
  Synthetic oligonucleotide
agcgggcgcgcgcactatgcggcga

SEQ ID NO: 732556 - DNA, 25 bp, Artificial sequence
  Synthetic oligonucleotide
tcacgctgatcgcggtccgcccccc

SEQ ID NO: 732557 - DNA, 25 bp, Artificial sequence
  Synthetic oligonucleotide
cccgagccggtgcgactcgccgact

SEQ ID NO: 732558 - DNA, 25 bp, Artificial sequence
  Synthetic oligonucleotide
ccgcgttcgcgttcgcccaccccac

SEQ ID NO: 732559 - DNA, 25 bp, Artificial sequence
  Synthetic oligonucleotide
ccgcgttcgcgtacgcccaccccac

SEQ ID NO: 732560 - DNA, 25 bp, Artificial sequence
  Synthetic oligonucleotide
ggcggataccggtacgcgctgggcc

SEQ ID NO: 732561 - DNA, 25 bp, Artificial sequence
  Synthetic oligonucleotide
ggcggataccggaacgcgctgggcc

SEQ ID NO: 732562 - DNA, 25 bp, Artificial sequence
  Synthetic oligonucleotide
ggccgacggtagttcgcgcggtccg

SEQ ID NO: 732563 - DNA, 25 bp, Artificial sequence
  Synthetic oligonucleotide
ggccgacggtagatcgcgcggtccg

SEQ ID NO: 732564 - DNA, 25 bp, Artificial sequence
  Synthetic oligonucleotide
cgggaccccggcccgcatactgtcc

SEQ ID NO: 732565 - DNA, 25 bp, Artificial sequence
  Synthetic oligonucleotide
cgggaccccggcgcgcatactgtcc

SEQ ID NO: 732566 - DNA, 25 bp, Artificial sequence
  Synthetic oligonucleotide
cagaggcggggttccaacgccgcgc

SEQ ID NO: 732567 - DNA, 25 bp, Artificial sequence
  Synthetic oligonucleotide
cagaggcggggtaccaacgccgcgc

SEQ ID NO: 732568 - DNA, 25 bp, Artificial sequence
  Synthetic oligonucleotide
gcacgctacggagcggcgtctccgg

SEQ ID NO: 732569 - DNA, 25 bp, Artificial sequence
  Synthetic oligonucleotide
cccgggcgcgacgcgcgataccttg

SEQ ID NO: 732570 - DNA, 25 bp, Artificial sequence
  Synthetic oligonucleotide
agggccatcggttgcgcgcggtcgg

SEQ ID NO: 732571 - DNA, 25 bp, Artificial sequence
  Synthetic oligonucleotide
cccgagccggtgggactcgccgact

SEQ ID NO: 732572 - DNA, 25 bp, Artificial sequence
  Synthetic oligonucleotide
ggccgggccgcgacacgttcctgac

SEQ ID NO: 732573 - DNA, 25 bp, Artificial sequence
  Synthetic oligonucleotide
ggccgggccgcgtcacgttcctgac

SEQ ID NO: 732574 - DNA, 25 bp, Artificial sequence
  Synthetic oligonucleotide
cccccccgcctagcggtcgatagcc

SEQ ID NO: 732575 - DNA, 25 bp, Artificial sequence
  Synthetic oligonucleotide
cccccccgcctaccggtcgatagcc

SEQ ID NO: 732576 - DNA, 25 bp, Artificial sequence
  Synthetic oligonucleotide
agggcgacgagtgcgcgtgcccctg

SEQ ID NO: 732577 - DNA, 25 bp, Artificial sequence
  Synthetic oligonucleotide
agggcgacgagtccgcgtgcccctg

SEQ ID NO: 732578 - DNA, 25 bp, Artificial sequence
  Synthetic oligonucleotide
cgatcggtgcgttcccccgcccagg

SEQ ID NO: 732579 - DNA, 25 bp, Artificial sequence
  Synthetic oligonucleotide
cgatcggtgcgtacccccgcccagg

SEQ ID NO: 732580 - DNA, 25 bp, Artificial sequence
  Synthetic oligonucleotide
ggggacgcgtcgcgtacagcggcca

SEQ ID NO: 732581 - DNA, 25 bp, Artificial sequence
  Synthetic oligonucleotide
cccgggcgcgacccgcgataccttg

SEQ ID NO: 732582 - DNA, 25 bp, Artificial sequence
  Synthetic oligonucleotide
gggccgtcgcgggataagggcaccg

SEQ ID NO: 732583 - DNA, 25 bp, Artificial sequence
  Synthetic oligonucleotide
cctgcgccgctacggcggtcttccc

SEQ ID NO: 732584 - DNA, 25 bp, Artificial sequence
  Synthetic oligonucleotide
gacggcgcggggaacgtcgacacgg

SEQ ID NO: 732585 - DNA, 25 bp, Artificial sequence
  Synthetic oligonucleotide
gacggcgcggggtacgtcgacacgg

SEQ ID NO: 732586 - DNA, 25 bp, Artificial sequence
  Synthetic oligonucleotide
cttcgcggctcgaacggcgggctgc

SEQ ID NO: 732587 - DNA, 25 bp, Artificial sequence
  Synthetic oligonucleotide
cttcgcggctcgtacggcgggctgc

SEQ ID NO: 732588 - DNA, 25 bp, Artificial sequence
  Synthetic oligonucleotide
gcggcgactacgggccggtgcgatc

SEQ ID NO: 732589 - DNA, 25 bp, Artificial sequence
  Synthetic oligonucleotide
gcggcgactacgcgccggtgcgatc

SEQ ID NO: 732590 - DNA, 25 bp, Artificial sequence
  Synthetic oligonucleotide
gcgtgcatcgatgcgcggtggcggc

SEQ ID NO: 732591 - DNA, 25 bp, Artificial sequence
  Synthetic oligonucleotide
gcgtgcatcgatccgcggtggcggc

SEQ ID NO: 732592 - DNA, 25 bp, Artificial sequence
  Synthetic oligonucleotide
gaggaggcgcaatcggacgggcccc

SEQ ID NO: 732593 - DNA, 25 bp, Artificial sequence
  Synthetic oligonucleotide
cctctccgtgcgtccggttgggggc

SEQ ID NO: 732594 - DNA, 25 bp, Artificial sequence
  Synthetic oligonucleotide
gggccgtcgcggcataagggcaccg

SEQ ID NO: 732595 - DNA, 25 bp, Artificial sequence
  Synthetic oligonucleotide
ggcgtgtcggcgttacgccgtggcc

SEQ ID NO: 732596 - DNA, 25 bp, Artificial sequence
  Synthetic oligonucleotide
ccccgcctacgcctcgcgggaacga

SEQ ID NO: 732597 - DNA, 25 bp, Artificial sequence
  Synthetic oligonucleotide
ccccgcctacgcgtcgcgggaacga

SEQ ID NO: 732598 - DNA, 25 bp, Artificial sequence
  Synthetic oligonucleotide
cgacggtccgcgtcgggcaggtcgt

SEQ ID NO: 732599 - DNA, 25 bp, Artificial sequence
  Synthetic oligonucleotide
cgacggtccgcgacgggcaggtcgt

SEQ ID NO: 732600 - DNA, 25 bp, Artificial sequence
  Synthetic oligonucleotide
ctgcgccgctagtcgcggagtcccc

SEQ ID NO: 732601 - DNA, 25 bp, Artificial sequence
  Synthetic oligonucleotide
ctgcgccgctagacgcggagtcccc

SEQ ID NO: 732602 - DNA, 25 bp, Artificial sequence
  Synthetic oligonucleotide
gatgcgacggatggcgcgccgccct

SEQ ID NO: 732603 - DNA, 25 bp, Artificial sequence
  Synthetic oligonucleotide
gatgcgacggatcgcgcgccgccct

SEQ ID NO: 732604 - DNA, 25 bp, Artificial sequence
  Synthetic oligonucleotide
agcgcccgacgcgagaccgctggac

SEQ ID NO: 732605 - DNA, 25 bp, Artificial sequence
  Synthetic oligonucleotide
ggcgacccgctaggcgagccttgcc

SEQ ID NO: 732606 - DNA, 25 bp, Artificial sequence
  Synthetic oligonucleotide
gaggaggcgcaaacggacgggcccc

SEQ ID NO: 732607 - DNA, 25 bp, Artificial sequence
  Synthetic oligonucleotide
ggccttcccgtatcgcgctcggggc

SEQ ID NO: 732608 - DNA, 25 bp, Artificial sequence
  Synthetic oligonucleotide
cgccggcgcggcctattcgtcggct

SEQ ID NO: 732609 - DNA, 25 bp, Artificial sequence
  Synthetic oligonucleotide
cgccggcgcggcgtattcgtcggct

SEQ ID NO: 732610 - DNA, 25 bp, Artificial sequence
  Synthetic oligonucleotide
actgggcgcggggacgatcgtcggg

SEQ ID NO: 732611 - DNA, 25 bp, Artificial sequence
  Synthetic oligonucleotide
actgggcgcgggcacgatcgtcggg

SEQ ID NO: 732612 - DNA, 25 bp, Artificial sequence
  Synthetic oligonucleotide
gtgcgcccgtcgaactgcggcgcag

SEQ ID NO: 732613 - DNA, 25 bp, Artificial sequence
  Synthetic oligonucleotide
gtgcgcccgtcgtactgcggcgcag

SEQ ID NO: 732614 - DNA, 25 bp, Artificial sequence
  Synthetic oligonucleotide
ggcacgcgcgcgattacccggcctc

SEQ ID NO: 732615 - DNA, 25 bp, Artificial sequence
  Synthetic oligonucleotide
ggcacgcgcgcgtttacccggcctc

SEQ ID NO: 732616 - DNA, 25 bp, Artificial sequence
  Synthetic oligonucleotide
ccccagctagcgggccgaccgactg

SEQ ID NO: 732617 - DNA, 25 bp, Artificial sequence
  Synthetic oligonucleotide
ccccagctagcgcgccgaccgactg

SEQ ID NO: 732618 - DNA, 25 bp, Artificial sequence
  Synthetic oligonucleotide
cctctccgtgcgaccggttgggggc

SEQ ID NO: 732619 - DNA, 25 bp, Artificial sequence
  Synthetic oligonucleotide
aggacggcgctaccgcaacggggcg

SEQ ID NO: 732620 - DNA, 25 bp, Artificial sequence
  Synthetic oligonucleotide
gccgccatcggcggcgactgagtgg

SEQ ID NO: 732621 - DNA, 25 bp, Artificial sequence
  Synthetic oligonucleotide
ggccttcccgtaacgcgctcggggc

SEQ ID NO: 732622 - DNA, 25 bp, Artificial sequence
  Synthetic oligonucleotide
gcccgcacgacccgctacgcctctg

SEQ ID NO: 732623 - DNA, 25 bp, Artificial sequence
  Synthetic oligonucleotide
gcccgcacgaccggctacgcctctg

SEQ ID NO: 732624 - DNA, 25 bp, Artificial sequence
  Synthetic oligonucleotide
gctgcctgcgacctacgggcgggga

SEQ ID NO: 732625 - DNA, 25 bp, Artificial sequence
  Synthetic oligonucleotide
gctgcctgcgacgtacgggcgggga

SEQ ID NO: 732626 - DNA, 25 bp, Artificial sequence
  Synthetic oligonucleotide
ccactcgtcgaaccgtgcggccggg

SEQ ID NO: 732627 - DNA, 25 bp, Artificial sequence
  Synthetic oligonucleotide
ccactcgtcgaagcgtgcggccggg

SEQ ID NO: 732628 - DNA, 25 bp, Artificial sequence
  Synthetic oligonucleotide
gtgggcacggtcccatcgctgccgg

SEQ ID NO: 732629 - DNA, 25 bp, Artificial sequence
  Synthetic oligonucleotide
gtgggcacggtcgcatcgctgccgg

SEQ ID NO: 732630 - DNA, 25 bp, Artificial sequence
  Synthetic oligonucleotide
ggcgtgtcggcgatacgccgtggcc

SEQ ID NO: 732631 - DNA, 25 bp, Artificial sequence
  Synthetic oligonucleotide
aggacggcgctagcgcaacggggcg

SEQ ID NO: 732632 - DNA, 25 bp, Artificial sequence
  Synthetic oligonucleotide
cgcaggcgcgaaccggtccttgccg

SEQ ID NO: 732633 - DNA, 25 bp, Artificial sequence
  Synthetic oligonucleotide
gcgacggggtatggggacgacgcgc

SEQ ID NO: 732634 - DNA, 25 bp, Artificial sequence
  Synthetic oligonucleotide
gtgctcaccgaaggtccgcgcgccg

SEQ ID NO: 732635 - DNA, 25 bp, Artificial sequence
  Synthetic oligonucleotide
ccgccaccgcgcctagtacggctcg

SEQ ID NO: 732636 - DNA, 25 bp, Artificial sequence
  Synthetic oligonucleotide
ccgccaccgcgcgtagtacggctcg

SEQ ID NO: 732637 - DNA, 25 bp, Artificial sequence
  Synthetic oligonucleotide
cgactgcgccacacgtacggccgcc

SEQ ID NO: 732638 - DNA, 25 bp, Artificial sequence
  Synthetic oligonucleotide
cgactgcgccactcgtacggccgcc

SEQ ID NO: 732639 - DNA, 25 bp, Artificial sequence
  Synthetic oligonucleotide
cgggccacgggcctacgaagcctgg

SEQ ID NO: 732640 - DNA, 25 bp, Artificial sequence
  Synthetic oligonucleotide
cgggccacgggcgtacgaagcctgg

SEQ ID NO: 732641 - DNA, 25 bp, Artificial sequence
  Synthetic oligonucleotide
gggccccggcattcgacggcgctag

SEQ ID NO: 732642 - DNA, 25 bp, Artificial sequence
  Synthetic oligonucleotide
gggccccggcatacgacggcgctag

SEQ ID NO: 732643 - DNA, 25 bp, Artificial sequence
  Synthetic oligonucleotide
gagcccgtcgtctcgacgaggccgc

SEQ ID NO: 732644 - DNA, 25 bp, Artificial sequence
  Synthetic oligonucleotide
atggcggagcgttctcgcgccgggc

SEQ ID NO: 732645 - DNA, 25 bp, Artificial sequence
  Synthetic oligonucleotide
gagcccgtcgtcacgacgaggccgc

SEQ ID NO: 732646 - DNA, 25 bp, Artificial sequence
  Synthetic oligonucleotide
cgcaggcgcgaagcggtccttgccg

SEQ ID NO: 732647 - DNA, 25 bp, Artificial sequence
  Synthetic oligonucleotide
gcggcactagccgggtacgtcggcc

SEQ ID NO: 732648 - DNA, 25 bp, Artificial sequence
  Synthetic oligonucleotide
gcggcactagcccggtacgtcggcc

SEQ ID NO: 732649 - DNA, 25 bp, Artificial sequence
  Synthetic oligonucleotide
tcgagggtcccggggcgtatgggcg

SEQ ID NO: 732650 - DNA, 25 bp, Artificial sequence
  Synthetic oligonucleotide
tcgagggtcccgcggcgtatgggcg

SEQ ID NO: 732651 - DNA, 25 bp, Artificial sequence
  Synthetic oligonucleotide
cgtccccgcgtccactaccgcgagc

SEQ ID NO: 732652 - DNA, 25 bp, Artificial sequence
  Synthetic oligonucleotide
cgtccccgcgtcgactaccgcgagc

SEQ ID NO: 732653 - DNA, 25 bp, Artificial sequence
  Synthetic oligonucleotide
gcgacggggtatcgggacgacgcgc

SEQ ID NO: 732654 - DNA, 25 bp, Artificial sequence
  Synthetic oligonucleotide
cggttgcccgaagttcgcggccgcc

SEQ ID NO: 732655 - DNA, 25 bp, Artificial sequence
  Synthetic oligonucleotide
tcgccgcggtacccgactctcggcc

SEQ ID NO: 732656 - DNA, 25 bp, Artificial sequence
  Synthetic oligonucleotide
atggcggagcgtactcgcgccgggc

SEQ ID NO: 732657 - DNA, 25 bp, Artificial sequence
  Synthetic oligonucleotide
cgcgacacccctccgcgaagtcgcg

SEQ ID NO: 732658 - DNA, 25 bp, Artificial sequence
  Synthetic oligonucleotide
gccgccatcggccgcgactgagtgg

SEQ ID NO: 732659 - DNA, 25 bp, Artificial sequence
  Synthetic oligonucleotide
ctggcgcgcgcgcttacctaccccc

SEQ ID NO: 732660 - DNA, 25 bp, Artificial sequence
  Synthetic oligonucleotide
ctggcgcgcgcggttacctaccccc

SEQ ID NO: 732661 - DNA, 25 bp, Artificial sequence
  Synthetic oligonucleotide
gcagagcctacgccgcgtaccgggg

SEQ ID NO: 732662 - DNA, 25 bp, Artificial sequence
  Synthetic oligonucleotide
gcagagcctacggcgcgtaccgggg

SEQ ID NO: 732663 - DNA, 25 bp, Artificial sequence
  Synthetic oligonucleotide
cggggttcgtgggcgcgacgagctg

SEQ ID NO: 732664 - DNA, 25 bp, Artificial sequence
  Synthetic oligonucleotide
cggggttcgtggccgcgacgagctg

SEQ ID NO: 732665 - DNA, 25 bp, Artificial sequence
  Synthetic oligonucleotide
cgctcggcccgttgcgacgcacagg

SEQ ID NO: 732666 - DNA, 25 bp, Artificial sequence
  Synthetic oligonucleotide
cgctcggcccgtagcgacgcacagg

SEQ ID NO: 732667 - DNA, 25 bp, Artificial sequence
  Synthetic oligonucleotide
cgcccggggtgcccccgttctgatc

SEQ ID NO: 732668 - DNA, 25 bp, Artificial sequence
  Synthetic oligonucleotide
gtgctcaccgaacgtccgcgcgccg

SEQ ID NO: 732669 - DNA, 25 bp, Artificial sequence
  Synthetic oligonucleotide
cgcgacacccctgcgcgaagtcgcg

SEQ ID NO: 732670 - DNA, 25 bp, Artificial sequence
  Synthetic oligonucleotide
agcgcccgacgccagaccgctggac

SEQ ID NO: 732671 - DNA, 25 bp, Artificial sequence
  Synthetic oligonucleotide
agagtggtcccgtacggcgcgccgg

SEQ ID NO: 732672 - DNA, 25 bp, Artificial sequence
  Synthetic oligonucleotide
agagtggtcccgaacggcgcgccgg

SEQ ID NO: 732673 - DNA, 25 bp, Artificial sequence
  Synthetic oligonucleotide
ccgcgtacgtcgggaccgatgggcg

SEQ ID NO: 732674 - DNA, 25 bp, Artificial sequence
  Synthetic oligonucleotide
ccgcgtacgtcgcgaccgatgggcg

SEQ ID NO: 732675 - DNA, 25 bp, Artificial sequence
  Synthetic oligonucleotide
gggaccgtagcgcgcccgagcacag

SEQ ID NO: 732676 - DNA, 25 bp, Artificial sequence
  Synthetic oligonucleotide
gggaccgtagcgggcccgagcacag

SEQ ID NO: 732677 - DNA, 25 bp, Artificial sequence
  Synthetic oligonucleotide
tcgccgcggtacgcgactctcggcc

SEQ ID NO: 732678 - DNA, 25 bp, Artificial sequence
  Synthetic oligonucleotide
ggcccacgtggtacgtcgcggccgt

SEQ ID NO: 732679 - DNA, 25 bp, Artificial sequence
  Synthetic oligonucleotide
gggccgttacggggcgcgcgcacaa

SEQ ID NO: 732680 - DNA, 25 bp, Artificial sequence
  Synthetic oligonucleotide
gggccgttacggcgcgcgcgcacaa

SEQ ID NO: 732681 - DNA, 25 bp, Artificial sequence
  Synthetic oligonucleotide
cgcccggggtgcgcccgttctgatc

SEQ ID NO: 732682 - DNA, 25 bp, Artificial sequence
  Synthetic oligonucleotide
agctcccgatcgtgcgggtgccgcg

SEQ ID NO: 732683 - DNA, 25 bp, Artificial sequence
  Synthetic oligonucleotide
ggaccgcgttgcgtcggtcccctgc

SEQ ID NO: 732684 - DNA, 25 bp, Artificial sequence
  Synthetic oligonucleotide
gcgcgcgtcgcgcgtataggtgcgg

SEQ ID NO: 732685 - DNA, 25 bp, Artificial sequence
  Synthetic oligonucleotide
cggccccgccgcccgtatggcattc

SEQ ID NO: 732686 - DNA, 25 bp, Artificial sequence
  Synthetic oligonucleotide
cgggcgccgaacggtcgagacgcct

SEQ ID NO: 732687 - DNA, 25 bp, Artificial sequence
  Synthetic oligonucleotide
cgggcgccgaaccgtcgagacgcct

SEQ ID NO: 732688 - DNA, 25 bp, Artificial sequence
  Synthetic oligonucleotide
tcgctcccgcgaggcgtagcgtgcc

SEQ ID NO: 732689 - DNA, 25 bp, Artificial sequence
  Synthetic oligonucleotide
tcgctcccgcgacgcgtagcgtgcc

SEQ ID NO: 732690 - DNA, 25 bp, Artificial sequence
  Synthetic oligonucleotide
cccgcccgttgcgcgtcgagtcacg

SEQ ID NO: 732691 - DNA, 25 bp, Artificial sequence
  Synthetic oligonucleotide
cccgcccgttgcccgtcgagtcacg

SEQ ID NO: 732692 - DNA, 25 bp, Artificial sequence
  Synthetic oligonucleotide
cccagcccgtcgaaccggatgcccc

SEQ ID NO: 732693 - DNA, 25 bp, Artificial sequence
  Synthetic oligonucleotide
gcggggctacggtcgtccgcacagc

SEQ ID NO: 732694 - DNA, 25 bp, Artificial sequence
  Synthetic oligonucleotide
agctcccgatcgagcgggtgccgcg

SEQ ID NO: 732695 - DNA, 25 bp, Artificial sequence
  Synthetic oligonucleotide
gtggcccacgggtcgtacgggaggc

SEQ ID NO: 732696 - DNA, 25 bp, Artificial sequence
  Synthetic oligonucleotide
cgtcgggccgtaggtagcggcaggg

SEQ ID NO: 732697 - DNA, 25 bp, Artificial sequence
  Synthetic oligonucleotide
cgtcgggccgtacgtagcggcaggg

SEQ ID NO: 732698 - DNA, 25 bp, Artificial sequence
  Synthetic oligonucleotide
cctgctacgtgtgcggacggccgcc

SEQ ID NO: 732699 - DNA, 25 bp, Artificial sequence
  Synthetic oligonucleotide
cctgctacgtgtccggacggccgcc

SEQ ID NO: 732700 - DNA, 25 bp, Artificial sequence
  Synthetic oligonucleotide
gtgcggccgatacaacgcggggcgg

SEQ ID NO: 732701 - DNA, 25 bp, Artificial sequence
  Synthetic oligonucleotide
gtgcggccgatagaacgcggggcgg

SEQ ID NO: 732702 - DNA, 25 bp, Artificial sequence
  Synthetic oligonucleotide
cgacagtacgtcccggccggacccg

SEQ ID NO: 732703 - DNA, 25 bp, Artificial sequence
  Synthetic oligonucleotide
cgacagtacgtcgcggccggacccg

SEQ ID NO: 732704 - DNA, 25 bp, Artificial sequence
  Synthetic oligonucleotide
taccgggtcgcgtatgcccggggcc

SEQ ID NO: 732705 - DNA, 25 bp, Artificial sequence
  Synthetic oligonucleotide
taccgggtcgcgaatgcccggggcc

SEQ ID NO: 732706 - DNA, 25 bp, Artificial sequence
  Synthetic oligonucleotide
cccagcccgtcgtaccggatgcccc

SEQ ID NO: 732707 - DNA, 25 bp, Artificial sequence
  Synthetic oligonucleotide
ccctggggccgaatacgcgcccgac

SEQ ID NO: 732708 - DNA, 25 bp, Artificial sequence
  Synthetic oligonucleotide
tgcgcctacgtacggcgcgcgtccg

SEQ ID NO: 732709 - DNA, 25 bp, Artificial sequence
  Synthetic oligonucleotide
tgcgcctacgtagggcgcgcgtccg

SEQ ID NO: 732710 - DNA, 25 bp, Artificial sequence
  Synthetic oligonucleotide
cctgcgccgctagggcggtcttccc

SEQ ID NO: 732711 - DNA, 25 bp, Artificial sequence
  Synthetic oligonucleotide
ggcgacccgctacgcgagccttgcc

SEQ ID NO: 732712 - DNA, 25 bp, Artificial sequence
  Synthetic oligonucleotide
ggttcctcgccgcaccgatcgggcc

SEQ ID NO: 732713 - DNA, 25 bp, Artificial sequence
  Synthetic oligonucleotide
ggttcctcgccggaccgatcgggcc

SEQ ID NO: 732714 - DNA, 25 bp, Artificial sequence
  Synthetic oligonucleotide
ccggccagcgtactcgcgcagaccc

SEQ ID NO: 732715 - DNA, 25 bp, Artificial sequence
  Synthetic oligonucleotide
ccggccagcgtagtcgcgcagaccc

SEQ ID NO: 732716 - DNA, 25 bp, Artificial sequence
  Synthetic oligonucleotide
ggcccgccgacccatacgggagcga

SEQ ID NO: 732717 - DNA, 25 bp, Artificial sequence
  Synthetic oligonucleotide
ggcccgccgaccgatacgggagcga

SEQ ID NO: 732718 - DNA, 25 bp, Artificial sequence
  Synthetic oligonucleotide
gcggggctacggacgtccgcacagc

SEQ ID NO: 732719 - DNA, 25 bp, Artificial sequence
  Synthetic oligonucleotide
cgactgcgtacgcccgagccccggt

SEQ ID NO: 732720 - DNA, 25 bp, Artificial sequence
  Synthetic oligonucleotide
cggccccgccgcgcgtatggcattc

SEQ ID NO: 732721 - DNA, 25 bp, Artificial sequence
  Synthetic oligonucleotide
ccctggggccgattacgcgcccgac

SEQ ID NO: 732722 - DNA, 25 bp, Artificial sequence
  Synthetic oligonucleotide
gagcgccgcgttggctagcacgcgg

SEQ ID NO: 732723 - DNA, 25 bp, Artificial sequence
  Synthetic oligonucleotide
gagcgccgcgttcgctagcacgcgg

SEQ ID NO: 732724 - DNA, 25 bp, Artificial sequence
  Synthetic oligonucleotide
cccacgatgccccaacgcgccctgc

SEQ ID NO: 732725 - DNA, 25 bp, Artificial sequence
  Synthetic oligonucleotide
cccacgatgcccgaacgcgccctgc

SEQ ID NO: 732726 - DNA, 25 bp, Artificial sequence
  Synthetic oligonucleotide
ctgggcatagcccgcgtcgcgcgtc

SEQ ID NO: 732727 - DNA, 25 bp, Artificial sequence
  Synthetic oligonucleotide
ctgggcatagccggcgtcgcgcgtc

SEQ ID NO: 732728 - DNA, 25 bp, Artificial sequence
  Synthetic oligonucleotide
gagcccccggtaggcttcggggcga

SEQ ID NO: 732729 - DNA, 25 bp, Artificial sequence
  Synthetic oligonucleotide
gagcccccggtacgcttcggggcga

SEQ ID NO: 732730 - DNA, 25 bp, Artificial sequence
  Synthetic oligonucleotide
gtggcccacgggacgtacgggaggc

SEQ ID NO: 732731 - DNA, 25 bp, Artificial sequence
  Synthetic oligonucleotide
cgactgcgtacggccgagccccggt

SEQ ID NO: 732732 - DNA, 25 bp, Artificial sequence
  Synthetic oligonucleotide
gggacgtagcgccctgacgtggccc

SEQ ID NO: 732733 - DNA, 25 bp, Artificial sequence
  Synthetic oligonucleotide
gcgcgtctacgacggccgtacgcgc

SEQ ID NO: 732734 - DNA, 25 bp, Artificial sequence
  Synthetic oligonucleotide
gcgcgtctacgagggccgtacgcgc

SEQ ID NO: 732735 - DNA, 25 bp, Artificial sequence
  Synthetic oligonucleotide
cgcggtctcggtggatcgcgcacgg

SEQ ID NO: 732736 - DNA, 25 bp, Artificial sequence
  Synthetic oligonucleotide
cgcggtctcggtcgatcgcgcacgg

SEQ ID NO: 732737 - DNA, 25 bp, Artificial sequence
  Synthetic oligonucleotide
ccacacgtccgatcgcgcgggcgca

SEQ ID NO: 732738 - DNA, 25 bp, Artificial sequence
  Synthetic oligonucleotide
ccacacgtccgaacgcgcgggcgca

SEQ ID NO: 732739 - DNA, 25 bp, Artificial sequence
  Synthetic oligonucleotide
cggagcccggcgtacaacgccccac

SEQ ID NO: 732740 - DNA, 25 bp, Artificial sequence
  Synthetic oligonucleotide
cggagcccggcgaacaacgccccac

SEQ ID NO: 732741 - DNA, 25 bp, Artificial sequence
  Synthetic oligonucleotide
gacgggtatcgcgacgccgtcgggg

SEQ ID NO: 732742 - DNA, 25 bp, Artificial sequence
  Synthetic oligonucleotide
gacgggtatcgccacgccgtcgggg

SEQ ID NO: 732743 - DNA, 25 bp, Artificial sequence
  Synthetic oligonucleotide
cacggcgcgcctggtacgagaggcg

SEQ ID NO: 732744 - DNA, 25 bp, Artificial sequence
  Synthetic oligonucleotide
gaagggcgtaaccgcgaggcccgcc

SEQ ID NO: 732745 - DNA, 25 bp, Artificial sequence
  Synthetic oligonucleotide
ccaaggggtatgccgcgcggcacgc

SEQ ID NO: 732746 - DNA, 25 bp, Artificial sequence
  Synthetic oligonucleotide
gggacgtagcgcgctgacgtggccc

SEQ ID NO: 732747 - DNA, 25 bp, Artificial sequence
  Synthetic oligonucleotide
cggccggacgcagcgacgagccatc

SEQ ID NO: 732748 - DNA, 25 bp, Artificial sequence
  Synthetic oligonucleotide
cggccggacgcaccgacgagccatc

SEQ ID NO: 732749 - DNA, 25 bp, Artificial sequence
  Synthetic oligonucleotide
gacgccttgacgctccgcgtggggc

SEQ ID NO: 732750 - DNA, 25 bp, Artificial sequence
  Synthetic oligonucleotide
gacgccttgacggtccgcgtggggc

SEQ ID NO: 732751 - DNA, 25 bp, Artificial sequence
  Synthetic oligonucleotide
gcgggttccgatcgagcgcgctggc

SEQ ID NO: 732752 - DNA, 25 bp, Artificial sequence
  Synthetic oligonucleotide
gcgggttccgatggagcgcgctggc

SEQ ID NO: 732753 - DNA, 25 bp, Artificial sequence
  Synthetic oligonucleotide
ccaaggggtatggcgcgcggcacgc

SEQ ID NO: 732754 - DNA, 25 bp, Artificial sequence
  Synthetic oligonucleotide
gcgcgcgtcgcgggtataggtgcgg

SEQ ID NO: 732755 - DNA, 25 bp, Artificial sequence
  Synthetic oligonucleotide
tgctgacggtcatcgcgcccgcccg

SEQ ID NO: 732756 - DNA, 25 bp, Artificial sequence
  Synthetic oligonucleotide
tgctgacggtcaacgcgcccgcccg

SEQ ID NO: 732757 - DNA, 25 bp, Artificial sequence
  Synthetic oligonucleotide
gaagggcgtaacggcgaggcccgcc

SEQ ID NO: 732758 - DNA, 25 bp, Artificial sequence
  Synthetic oligonucleotide
cggcggccgtcgccgcaagttacgg

SEQ ID NO: 732759 - DNA, 25 bp, Artificial sequence
  Synthetic oligonucleotide
ggaccgcgttgcctcggtcccctgc

SEQ ID NO: 732760 - DNA, 25 bp, Artificial sequence
  Synthetic oligonucleotide
cacggcgcgcctcgtacgagaggcg

SEQ ID NO: 732761 - DNA, 25 bp, Artificial sequence
  Synthetic oligonucleotide
cgctcccgcgaaccggttggcagcg

SEQ ID NO: 732762 - DNA, 25 bp, Artificial sequence
  Synthetic oligonucleotide
cgctcccgcgaagcggttggcagcg

SEQ ID NO: 732763 - DNA, 25 bp, Artificial sequence
  Synthetic oligonucleotide
cggcggccgtcggcgcaagttacgg

SEQ ID NO: 732764 - DNA, 25 bp, Artificial sequence
  Synthetic oligonucleotide
gctggcgctacccgcggtagcgtcg

SEQ ID NO: 732765 - DNA, 25 bp, Artificial sequence
  Synthetic oligonucleotide
gctggcgctaccggcggtagcgtcg

SEQ ID NO: 732766 - DNA, 25 bp, Artificial sequence
  Synthetic oligonucleotide
ggccgcatagactcgcgcgccccca

SEQ ID NO: 732767 - DNA, 25 bp, Artificial sequence
  Synthetic oligonucleotide
ggccgcatagacacgcgcgccccca

SEQ ID NO: 732768 - DNA, 25 bp, Artificial sequence
  Synthetic oligonucleotide
gtcccgacggcgtcgcgtggtgtcc

SEQ ID NO: 732769 - DNA, 25 bp, Artificial sequence
  Synthetic oligonucleotide
gtcccgacggcgacgcgtggtgtcc

SEQ ID NO: 732770 - DNA, 25 bp, Artificial sequence
  Synthetic oligonucleotide
gcgcggctagcgaatcgcgctcccg

SEQ ID NO: 732771 - DNA, 25 bp, Artificial sequence
  Synthetic oligonucleotide
ggagcgctacgccacggcgcgctac

SEQ ID NO: 732772 - DNA, 25 bp, Artificial sequence
  Synthetic oligonucleotide
ggacgctcgcgccgttggggcaagg

SEQ ID NO: 732773 - DNA, 25 bp, Artificial sequence
  Synthetic oligonucleotide
ggacgctcgcgcggttggggcaagg

SEQ ID NO: 732774 - DNA, 25 bp, Artificial sequence
  Synthetic oligonucleotide
ctcgggcgatcgcctacgggcaggc

SEQ ID NO: 732775 - DNA, 25 bp, Artificial sequence
  Synthetic oligonucleotide
ctcgggcgatcggctacgggcaggc

SEQ ID NO: 732776 - DNA, 25 bp, Artificial sequence
  Synthetic oligonucleotide
ccccggggtatggccgcgctagcct

SEQ ID NO: 732777 - DNA, 25 bp, Artificial sequence
  Synthetic oligonucleotide
ccccggggtatgcccgcgctagcct

SEQ ID NO: 732778 - DNA, 25 bp, Artificial sequence
  Synthetic oligonucleotide
cgtcggcgcatacgcggctggcctg

SEQ ID NO: 732779 - DNA, 25 bp, Artificial sequence
  Synthetic oligonucleotide
cgtcggcgcataggcggctggcctg

SEQ ID NO: 732780 - DNA, 25 bp, Artificial sequence
  Synthetic oligonucleotide
ggagcgctacgcgacggcgcgctac

SEQ ID NO: 732781 - DNA, 25 bp, Artificial sequence
  Synthetic oligonucleotide
gcgcggctagcgtatcgcgctcccg

SEQ ID NO: 732782 - DNA, 25 bp, Artificial sequence
  Synthetic oligonucleotide
agcgggaccgccctcggaccggtgc

SEQ ID NO: 732783 - DNA, 25 bp, Artificial sequence
  Synthetic oligonucleotide
ggcgccgcatccgtacgcggtgggc

SEQ ID NO: 732784 - DNA, 25 bp, Artificial sequence
  Synthetic oligonucleotide
ggcgccgcatccctacgcggtgggc

SEQ ID NO: 732785 - DNA, 25 bp, Artificial sequence
  Synthetic oligonucleotide
ccgccgtatcgcggaccgccgaccg

SEQ ID NO: 732786 - DNA, 25 bp, Artificial sequence
  Synthetic oligonucleotide
ccgccgtatcgccgaccgccgaccg

SEQ ID NO: 732787 - DNA, 25 bp, Artificial sequence
  Synthetic oligonucleotide
ggccgccgccgaggtacgctgcggt

SEQ ID NO: 732788 - DNA, 25 bp, Artificial sequence
  Synthetic oligonucleotide
ggccgccgccgacgtacgctgcggt

SEQ ID NO: 732789 - DNA, 25 bp, Artificial sequence
  Synthetic oligonucleotide
gccccacgccagaacgcgaggcgcg

SEQ ID NO: 732790 - DNA, 25 bp, Artificial sequence
  Synthetic oligonucleotide
tgcggcctacgggcgcgatgggggc

SEQ ID NO: 732791 - DNA, 25 bp, Artificial sequence
  Synthetic oligonucleotide
gcgtgccgcgtcgaccggtcgccgt

SEQ ID NO: 732792 - DNA, 25 bp, Artificial sequence
  Synthetic oligonucleotide
cctcgccgacgcggaccgtgtgccg

SEQ ID NO: 732793 - DNA, 25 bp, Artificial sequence
  Synthetic oligonucleotide
agcgggaccgccgtcggaccggtgc

SEQ ID NO: 732794 - DNA, 25 bp, Artificial sequence
  Synthetic oligonucleotide
ggcggcgcgcgcggattaggcccac

SEQ ID NO: 732795 - DNA, 25 bp, Artificial sequence
  Synthetic oligonucleotide
ggcggcgcgcgccgattaggcccac

SEQ ID NO: 732796 - DNA, 25 bp, Artificial sequence
  Synthetic oligonucleotide
ttcgccgtacgagggccccgcgcgc

SEQ ID NO: 732797 - DNA, 25 bp, Artificial sequence
  Synthetic oligonucleotide
cgcaggggccgcgcgataggcgctc

SEQ ID NO: 732798 - DNA, 25 bp, Artificial sequence
  Synthetic oligonucleotide
tgcggcctacggccgcgatgggggc

SEQ ID NO: 732799 - DNA, 25 bp, Artificial sequence
  Synthetic oligonucleotide
agggcgggatacgaccggccggcgc

SEQ ID NO: 732800 - DNA, 25 bp, Artificial sequence
  Synthetic oligonucleotide
agggcgggataccaccggccggcgc

SEQ ID NO: 732801 - DNA, 25 bp, Artificial sequence
  Synthetic oligonucleotide
ttcgccgtacgacggccccgcgcgc

SEQ ID NO: 732802 - DNA, 25 bp, Artificial sequence
  Synthetic oligonucleotide
gccccacgccagtacgcgaggcgcg

SEQ ID NO: 732803 - DNA, 25 bp, Artificial sequence
  Synthetic oligonucleotide
ccgccgatcgaccgtcgcggggcga

SEQ ID NO: 732804 - DNA, 25 bp, Artificial sequence
  Synthetic oligonucleotide
cgcaggggccgcccgataggcgctc

SEQ ID NO: 732805 - DNA, 25 bp, Artificial sequence
  Synthetic oligonucleotide
agtgcgccgctcccgcgtacccccg

SEQ ID NO: 732806 - DNA, 25 bp, Artificial sequence
  Synthetic oligonucleotide
gccggccgaccgacggggtgagacc

SEQ ID NO: 732807 - DNA, 25 bp, Artificial sequence
  Synthetic oligonucleotide
ccgggccacgtcgcgcgacagtgcc

SEQ ID NO: 732808 - DNA, 25 bp, Artificial sequence
  Synthetic oligonucleotide
ccccgacgtacgcgatccgcccgcc

SEQ ID NO: 732809 - DNA, 25 bp, Artificial sequence
  Synthetic oligonucleotide
cggccccgcgcttggcgacagtcgg

SEQ ID NO: 732810 - DNA, 25 bp, Artificial sequence
  Synthetic oligonucleotide
cggccccgcgctaggcgacagtcgg

SEQ ID NO: 732811 - DNA, 25 bp, Artificial sequence
  Synthetic oligonucleotide
gcggtgtgcgacggcccgtgcgcac

SEQ ID NO: 732812 - DNA, 25 bp, Artificial sequence
  Synthetic oligonucleotide
gcggtgtgcgaccgcccgtgcgcac

SEQ ID NO: 732813 - DNA, 25 bp, Artificial sequence
  Synthetic oligonucleotide
agccgccctatcgtcgggcgcccgc

SEQ ID NO: 732814 - DNA, 25 bp, Artificial sequence
  Synthetic oligonucleotide
agccgccctatcctcgggcgcccgc

SEQ ID NO: 732815 - DNA, 25 bp, Artificial sequence
  Synthetic oligonucleotide
tggcacgggtcgcgtacgccggccg

SEQ ID NO: 732816 - DNA, 25 bp, Artificial sequence
  Synthetic oligonucleotide
ggcccttaccgggacgtcgcgccgg

SEQ ID NO: 732817 - DNA, 25 bp, Artificial sequence
  Synthetic oligonucleotide
agtgcgccgctcgcgcgtacccccg

SEQ ID NO: 732818 - DNA, 25 bp, Artificial sequence
  Synthetic oligonucleotide
caggcccgaccgccatcgccctgcc

SEQ ID NO: 732819 - DNA, 25 bp, Artificial sequence
  Synthetic oligonucleotide
ccgccgatcgacggtcgcggggcga

SEQ ID NO: 732820 - DNA, 25 bp, Artificial sequence
  Synthetic oligonucleotide
ccccgacgtacgggatccgcccgcc

SEQ ID NO: 732821 - DNA, 25 bp, Artificial sequence
  Synthetic oligonucleotide
ggcccttaccggcacgtcgcgccgg

SEQ ID NO: 732822 - DNA, 25 bp, Artificial sequence
  Synthetic oligonucleotide
ggagcgcgggtagtgcggcccgctg

SEQ ID NO: 732823 - DNA, 25 bp, Artificial sequence
  Synthetic oligonucleotide
ggagcgcgggtactgcggcccgctg

SEQ ID NO: 732824 - DNA, 25 bp, Artificial sequence
  Synthetic oligonucleotide
gcccccgtacgttgcccgccgctcc

SEQ ID NO: 732825 - DNA, 25 bp, Artificial sequence
  Synthetic oligonucleotide
gcccccgtacgtagcccgccgctcc

SEQ ID NO: 732826 - DNA, 25 bp, Artificial sequence
  Synthetic oligonucleotide
ctgggcgtcgatggcgggtccggcg

SEQ ID NO: 732827 - DNA, 25 bp, Artificial sequence
  Synthetic oligonucleotide
ctgggcgtcgatcgcgggtccggcg

SEQ ID NO: 732828 - DNA, 25 bp, Artificial sequence
  Synthetic oligonucleotide
caggcccgaccggcatcgccctgcc

SEQ ID NO: 732829 - DNA, 25 bp, Artificial sequence
  Synthetic oligonucleotide
tggcacgggtcgggtacgccggccg

SEQ ID NO: 732830 - DNA, 25 bp, Artificial sequence
  Synthetic oligonucleotide
gaggggttatcgcgcgcggccggcc

SEQ ID NO: 732831 - DNA, 25 bp, Artificial sequence
  Synthetic oligonucleotide
gacgcctctacggcgcgccgctccc

SEQ ID NO: 732832 - DNA, 25 bp, Artificial sequence
  Synthetic oligonucleotide
cgtgcgggtagcgcggacggcgcac

SEQ ID NO: 732833 - DNA, 25 bp, Artificial sequence
  Synthetic oligonucleotide
cgtgcgggtagcccggacggcgcac

SEQ ID NO: 732834 - DNA, 25 bp, Artificial sequence
  Synthetic oligonucleotide
cgcggcgcccgttcgacggcggtac

SEQ ID NO: 732835 - DNA, 25 bp, Artificial sequence
  Synthetic oligonucleotide
cgcggcgcccgtacgacggcggtac

SEQ ID NO: 732836 - DNA, 25 bp, Artificial sequence
  Synthetic oligonucleotide
gcggagcgaccgtgcgggtctgggc

SEQ ID NO: 732837 - DNA, 25 bp, Artificial sequence
  Synthetic oligonucleotide
gcggagcgaccgagcgggtctgggc

SEQ ID NO: 732838 - DNA, 25 bp, Artificial sequence
  Synthetic oligonucleotide
gcaggccgtcagttcgcggggcgcg

SEQ ID NO: 732839 - DNA, 25 bp, Artificial sequence
  Synthetic oligonucleotide
gcaggccgtcagatcgcggggcgcg

SEQ ID NO: 732840 - DNA, 25 bp, Artificial sequence
  Synthetic oligonucleotide
gagccccccgacccgagacgggtcc

SEQ ID NO: 732841 - DNA, 25 bp, Artificial sequence
  Synthetic oligonucleotide
tggcctcccgcgaacggtgcggccc

SEQ ID NO: 732842 - DNA, 25 bp, Artificial sequence
  Synthetic oligonucleotide
gaggggttatcgggcgcggccggcc

SEQ ID NO: 732843 - DNA, 25 bp, Artificial sequence
  Synthetic oligonucleotide
gggctcacgcgcggtactggcggcg

SEQ ID NO: 732844 - DNA, 25 bp, Artificial sequence
  Synthetic oligonucleotide
gggcgcctcatgggcgcgacgcacc

SEQ ID NO: 732845 - DNA, 25 bp, Artificial sequence
  Synthetic oligonucleotide
gggcgcctcatgcgcgcgacgcacc

SEQ ID NO: 732846 - DNA, 25 bp, Artificial sequence
  Synthetic oligonucleotide
gcggcgtcgcgaccgcactcgcctg

SEQ ID NO: 732847 - DNA, 25 bp, Artificial sequence
  Synthetic oligonucleotide
gcggcgtcgcgagcgcactcgcctg

SEQ ID NO: 732848 - DNA, 25 bp, Artificial sequence
  Synthetic oligonucleotide
ttggcgccgcggctcgacgggcctc

SEQ ID NO: 732849 - DNA, 25 bp, Artificial sequence
  Synthetic oligonucleotide
ttggcgccgcgggtcgacgggcctc

SEQ ID NO: 732850 - DNA, 25 bp, Artificial sequence
  Synthetic oligonucleotide
gacggctacgcgcccccgtgtcggc

SEQ ID NO: 732851 - DNA, 25 bp, Artificial sequence
  Synthetic oligonucleotide
gacggctacgcggccccgtgtcggc

SEQ ID NO: 732852 - DNA, 25 bp, Artificial sequence
  Synthetic oligonucleotide
gacgcctctacgccgcgccgctccc

SEQ ID NO: 732853 - DNA, 25 bp, Artificial sequence
  Synthetic oligonucleotide
gtcgccggcgtacgcgtgagcgccg

SEQ ID NO: 732854 - DNA, 25 bp, Artificial sequence
  Synthetic oligonucleotide
gagccccccgacgcgagacgggtcc

SEQ ID NO: 732855 - DNA, 25 bp, Artificial sequence
  Synthetic oligonucleotide
gagggctagcggacgaccgccgggg

SEQ ID NO: 732856 - DNA, 25 bp, Artificial sequence
  Synthetic oligonucleotide
cgtcccatcgcgcggactggcgcgg

SEQ ID NO: 732857 - DNA, 25 bp, Artificial sequence
  Synthetic oligonucleotide
cgtcccatcgcggggactggcgcgg

SEQ ID NO: 732858 - DNA, 25 bp, Artificial sequence
  Synthetic oligonucleotide
gggccggcctcgggatacggacccc

SEQ ID NO: 732859 - DNA, 25 bp, Artificial sequence
  Synthetic oligonucleotide
gggccggcctcgcgatacggacccc

SEQ ID NO: 732860 - DNA, 25 bp, Artificial sequence
  Synthetic oligonucleotide
tcgcggcccggtccgtcgtgctggc

SEQ ID NO: 732861 - DNA, 25 bp, Artificial sequence
  Synthetic oligonucleotide
tcgcggcccggtgcgtcgtgctggc

SEQ ID NO: 732862 - DNA, 25 bp, Artificial sequence
  Synthetic oligonucleotide
ccgcatgaacgtgcccgcgccgggg

SEQ ID NO: 732863 - DNA, 25 bp, Artificial sequence
  Synthetic oligonucleotide
ccgcatgaacgtccccgcgccgggg

SEQ ID NO: 732864 - DNA, 25 bp, Artificial sequence
  Synthetic oligonucleotide
ccggcccgcaccggtaggacacgcg

SEQ ID NO: 732865 - DNA, 25 bp, Artificial sequence
  Synthetic oligonucleotide
ccggcccgcacccgtaggacacgcg

SEQ ID NO: 732866 - DNA, 25 bp, Artificial sequence
  Synthetic oligonucleotide
tggcctcccgcgtacggtgcggccc

SEQ ID NO: 732867 - DNA, 25 bp, Artificial sequence
  Synthetic oligonucleotide
cgcagggcgaaccgcgcagcaggcg

SEQ ID NO: 732868 - DNA, 25 bp, Artificial sequence
  Synthetic oligonucleotide
gccggccgaccgtcggggtgagacc

SEQ ID NO: 732869 - DNA, 25 bp, Artificial sequence
  Synthetic oligonucleotide
gagggctagcggtcgaccgccgggg

SEQ ID NO: 732870 - DNA, 25 bp, Artificial sequence
  Synthetic oligonucleotide
gggtcggtatcgggccccgcaggcg

SEQ ID NO: 732871 - DNA, 25 bp, Artificial sequence
  Synthetic oligonucleotide
gggtcggtatcgcgccccgcaggcg

SEQ ID NO: 732872 - DNA, 25 bp, Artificial sequence
  Synthetic oligonucleotide
ggtgcgcgcttagggcgtccccccc

SEQ ID NO: 732873 - DNA, 25 bp, Artificial sequence
  Synthetic oligonucleotide
ggtgcgcgcttacggcgtccccccc

SEQ ID NO: 732874 - DNA, 25 bp, Artificial sequence
  Synthetic oligonucleotide
ggctgacgtcacgggaccgcgcccg

SEQ ID NO: 732875 - DNA, 25 bp, Artificial sequence
  Synthetic oligonucleotide
ggctgacgtcaccggaccgcgcccg

SEQ ID NO: 732876 - DNA, 25 bp, Artificial sequence
  Synthetic oligonucleotide
gggccgcgatgcgctaccggagccg

SEQ ID NO: 732877 - DNA, 25 bp, Artificial sequence
  Synthetic oligonucleotide
gggccgcgatgccctaccggagccg

SEQ ID NO: 732878 - DNA, 25 bp, Artificial sequence
  Synthetic oligonucleotide
gggctcacgcgccgtactggcggcg

SEQ ID NO: 732879 - DNA, 25 bp, Artificial sequence
  Synthetic oligonucleotide
cgcagggcgaacggcgcagcaggcg

SEQ ID NO: 732880 - DNA, 25 bp, Artificial sequence
  Synthetic oligonucleotide
cggtgccgtcgcctaccgagcccgc

SEQ ID NO: 732881 - DNA, 25 bp, Artificial sequence
  Synthetic oligonucleotide
cgtgggcgacgcccgacgactccgc

SEQ ID NO: 732882 - DNA, 25 bp, Artificial sequence
  Synthetic oligonucleotide
ggcgccgcgtaggggcgaatccccg

SEQ ID NO: 732883 - DNA, 25 bp, Artificial sequence
  Synthetic oligonucleotide
cggcgccatactggcgcgggcaccg

SEQ ID NO: 732884 - DNA, 25 bp, Artificial sequence
  Synthetic oligonucleotide
cggcgccatactcgcgcgggcaccg

SEQ ID NO: 732885 - DNA, 25 bp, Artificial sequence
  Synthetic oligonucleotide
cgacgggtacgccggactccgcgcc

SEQ ID NO: 732886 - DNA, 25 bp, Artificial sequence
  Synthetic oligonucleotide
cgacgggtacgcgggactccgcgcc

SEQ ID NO: 732887 - DNA, 25 bp, Artificial sequence
  Synthetic oligonucleotide
ggttggccgcgcgtatggggccggc

SEQ ID NO: 732888 - DNA, 25 bp, Artificial sequence
  Synthetic oligonucleotide
ggttggccgcgcctatggggccggc

SEQ ID NO: 732889 - DNA, 25 bp, Artificial sequence
  Synthetic oligonucleotide
cgccagtcgtacggccgggcgcgtg

SEQ ID NO: 732890 - DNA, 25 bp, Artificial sequence
  Synthetic oligonucleotide
cgccagtcgtaccgccgggcgcgtg

SEQ ID NO: 732891 - DNA, 25 bp, Artificial sequence
  Synthetic oligonucleotide
gctgcggtactgcaccgcggccgcc

SEQ ID NO: 732892 - DNA, 25 bp, Artificial sequence
  Synthetic oligonucleotide
cctagggtgctcgcgcgaccccccg

SEQ ID NO: 732893 - DNA, 25 bp, Artificial sequence
  Synthetic oligonucleotide
gctgcggtactggaccgcggccgcc

SEQ ID NO: 732894 - DNA, 25 bp, Artificial sequence
  Synthetic oligonucleotide
cggtgccgtcgcgtaccgagcccgc

SEQ ID NO: 732895 - DNA, 25 bp, Artificial sequence
  Synthetic oligonucleotide
caagggcggtcgacggtgcggggcg

SEQ ID NO: 732896 - DNA, 25 bp, Artificial sequence
  Synthetic oligonucleotide
caagggcggtcgtcggtgcggggcg

SEQ ID NO: 732897 - DNA, 25 bp, Artificial sequence
  Synthetic oligonucleotide
tgcgcgcacgcgcagcgtacggccg

SEQ ID NO: 732898 - DNA, 25 bp, Artificial sequence
  Synthetic oligonucleotide
tgcgcgcacgcggagcgtacggccg

SEQ ID NO: 732899 - DNA, 25 bp, Artificial sequence
  Synthetic oligonucleotide
ccggcgagacgtcggacgccggagc

SEQ ID NO: 732900 - DNA, 25 bp, Artificial sequence
  Synthetic oligonucleotide
ccggcgagacgtgggacgccggagc

SEQ ID NO: 732901 - DNA, 25 bp, Artificial sequence
  Synthetic oligonucleotide
cctccccgccacgagcgacccctgg

SEQ ID NO: 732902 - DNA, 25 bp, Artificial sequence
  Synthetic oligonucleotide
cctccccgccaccagcgacccctgg

SEQ ID NO: 732903 - DNA, 25 bp, Artificial sequence
  Synthetic oligonucleotide
gttgccacgggccgtcgcacccggc

SEQ ID NO: 732904 - DNA, 25 bp, Artificial sequence
  Synthetic oligonucleotide
cctagggtgctcccgcgaccccccg

SEQ ID NO: 732905 - DNA, 25 bp, Artificial sequence
  Synthetic oligonucleotide
gggggcagcgacggcctacgcccct

SEQ ID NO: 732906 - DNA, 25 bp, Artificial sequence
  Synthetic oligonucleotide
cctcgccgacgccgaccgtgtgccg

SEQ ID NO: 732907 - DNA, 25 bp, Artificial sequence
  Synthetic oligonucleotide
cgtgggcgacgcgcgacgactccgc

SEQ ID NO: 732908 - DNA, 25 bp, Artificial sequence
  Synthetic oligonucleotide
ccgggccacgtcccgcgacagtgcc

SEQ ID NO: 732909 - DNA, 25 bp, Artificial sequence
  Synthetic oligonucleotide
gcgccgcggccgcgacatagcgtgc

SEQ ID NO: 732910 - DNA, 25 bp, Artificial sequence
  Synthetic oligonucleotide
gcgccgcggccgggacatagcgtgc

SEQ ID NO: 732911 - DNA, 25 bp, Artificial sequence
  Synthetic oligonucleotide
ggcgcaccgacgggagacccctgcc

SEQ ID NO: 732912 - DNA, 25 bp, Artificial sequence
  Synthetic oligonucleotide
ggcgcaccgacgcgagacccctgcc

SEQ ID NO: 732913 - DNA, 25 bp, Artificial sequence
  Synthetic oligonucleotide
gtcggcgggcgctaccgatcgcgcc

SEQ ID NO: 732914 - DNA, 25 bp, Artificial sequence
  Synthetic oligonucleotide
gtcggcgggcgcaaccgatcgcgcc

SEQ ID NO: 732915 - DNA, 25 bp, Artificial sequence
  Synthetic oligonucleotide
gcgcccatcgacgctcgcggcaggc

SEQ ID NO: 732916 - DNA, 25 bp, Artificial sequence
  Synthetic oligonucleotide
ggcgccgcgtagcggcgaatccccg

SEQ ID NO: 732917 - DNA, 25 bp, Artificial sequence
  Synthetic oligonucleotide
gggggcagcgaccgcctacgcccct

SEQ ID NO: 732918 - DNA, 25 bp, Artificial sequence
  Synthetic oligonucleotide
cccgcctggtcgaccgcggacgtcc

SEQ ID NO: 732919 - DNA, 25 bp, Artificial sequence
  Synthetic oligonucleotide
ggcgcccagcgcacgtacggcccca

SEQ ID NO: 732920 - DNA, 25 bp, Artificial sequence
  Synthetic oligonucleotide
ggcgcccagcgctcgtacggcccca

SEQ ID NO: 732921 - DNA, 25 bp, Artificial sequence
  Synthetic oligonucleotide
cctgcggtacgcccggtaccccggc

SEQ ID NO: 732922 - DNA, 25 bp, Artificial sequence
  Synthetic oligonucleotide
cctgcggtacgcgcggtaccccggc

SEQ ID NO: 732923 - DNA, 25 bp, Artificial sequence
  Synthetic oligonucleotide
acccggcgcgcgacatagccggccc

SEQ ID NO: 732924 - DNA, 25 bp, Artificial sequence
  Synthetic oligonucleotide
acccggcgcgcgtcatagccggccc

SEQ ID NO: 732925 - DNA, 25 bp, Artificial sequence
  Synthetic oligonucleotide
ctggggccgtcaacgggcggccgac

SEQ ID NO: 732926 - DNA, 25 bp, Artificial sequence
  Synthetic oligonucleotide
ctggggccgtcatcgggcggccgac

SEQ ID NO: 732927 - DNA, 25 bp, Artificial sequence
  Synthetic oligonucleotide
tgggcggctagccgtacgcgccccg

SEQ ID NO: 732928 - DNA, 25 bp, Artificial sequence
  Synthetic oligonucleotide
tgggcggctagcggtacgcgccccg

SEQ ID NO: 732929 - DNA, 25 bp, Artificial sequence
  Synthetic oligonucleotide
gcgcccatcgaccctcgcggcaggc

SEQ ID NO: 732930 - DNA, 25 bp, Artificial sequence
  Synthetic oligonucleotide
gcaccccgccgtaggctcgggcctg

SEQ ID NO: 732931 - DNA, 25 bp, Artificial sequence
  Synthetic oligonucleotide
ggcgactacgttcggcgccggcgcg

SEQ ID NO: 732932 - DNA, 25 bp, Artificial sequence
  Synthetic oligonucleotide
gcccgtcgctaccgcccgtcgtccc

SEQ ID NO: 732933 - DNA, 25 bp, Artificial sequence
  Synthetic oligonucleotide
gcccgtcgctacggcccgtcgtccc

SEQ ID NO: 732934 - DNA, 25 bp, Artificial sequence
  Synthetic oligonucleotide
gtcggcgtaacgccgcgccgctggc

SEQ ID NO: 732935 - DNA, 25 bp, Artificial sequence
  Synthetic oligonucleotide
gtcggcgtaacggcgcgccgctggc

SEQ ID NO: 732936 - DNA, 25 bp, Artificial sequence
  Synthetic oligonucleotide
cgccacgcccgtacgccgtgacggc

SEQ ID NO: 732937 - DNA, 25 bp, Artificial sequence
  Synthetic oligonucleotide
cgccacgcccgttcgccgtgacggc

SEQ ID NO: 732938 - DNA, 25 bp, Artificial sequence
  Synthetic oligonucleotide
gccgccgtacgacccggacgctcgc

SEQ ID NO: 732939 - DNA, 25 bp, Artificial sequence
  Synthetic oligonucleotide
gccgccgtacgagccggacgctcgc

SEQ ID NO: 732940 - DNA, 25 bp, Artificial sequence
  Synthetic oligonucleotide
agcgcctagacgccacgcggcccgg

SEQ ID NO: 732941 - DNA, 25 bp, Artificial sequence
  Synthetic oligonucleotide
gttgccacgggcggtcgcacccggc

SEQ ID NO: 732942 - DNA, 25 bp, Artificial sequence
  Synthetic oligonucleotide
gcaccccgccgttggctcgggcctg

SEQ ID NO: 732943 - DNA, 25 bp, Artificial sequence
  Synthetic oligonucleotide
cctccgcctatgggcgacgggccgg

SEQ ID NO: 732944 - DNA, 25 bp, Artificial sequence
  Synthetic oligonucleotide
ctcccgccacgtatccgcgccgcgg

SEQ ID NO: 732945 - DNA, 25 bp, Artificial sequence
  Synthetic oligonucleotide
ctcccgccacgtttccgcgccgcgg

SEQ ID NO: 732946 - DNA, 25 bp, Artificial sequence
  Synthetic oligonucleotide
cgccgaacggacccgcgacgtcccc

SEQ ID NO: 732947 - DNA, 25 bp, Artificial sequence
  Synthetic oligonucleotide
cgccgaacggacgcgcgacgtcccc

SEQ ID NO: 732948 - DNA, 25 bp, Artificial sequence
  Synthetic oligonucleotide
gggcgctacgcgcggtcgactgcgc

SEQ ID NO: 732949 - DNA, 25 bp, Artificial sequence
  Synthetic oligonucleotide
gggcgctacgcggggtcgactgcgc

SEQ ID NO: 732950 - DNA, 25 bp, Artificial sequence
  Synthetic oligonucleotide
gggccgcgtcccctcacgacgctgc

SEQ ID NO: 732951 - DNA, 25 bp, Artificial sequence
  Synthetic oligonucleotide
gggccgcgtcccgtcacgacgctgc

SEQ ID NO: 732952 - DNA, 25 bp, Artificial sequence
  Synthetic oligonucleotide
cagccggctacggtccgcgacggcg

SEQ ID NO: 732953 - DNA, 25 bp, Artificial sequence
  Synthetic oligonucleotide
cagccggctacgctccgcgacggcg

SEQ ID NO: 732954 - DNA, 25 bp, Artificial sequence
  Synthetic oligonucleotide
agcgcctagacggcacgcggcccgg

SEQ ID NO: 732955 - DNA, 25 bp, Artificial sequence
  Synthetic oligonucleotide
cggggctcgcgtgtacggtccgccc

SEQ ID NO: 732956 - DNA, 25 bp, Artificial sequence
  Synthetic oligonucleotide
gtcgccggcgtaggcgtgagcgccg

SEQ ID NO: 732957 - DNA, 25 bp, Artificial sequence
  Synthetic oligonucleotide
agcggcggcgtatcacgcccgcccg

SEQ ID NO: 732958 - DNA, 25 bp, Artificial sequence
  Synthetic oligonucleotide
agcggcggcgtaacacgcccgcccg

SEQ ID NO: 732959 - DNA, 25 bp, Artificial sequence
  Synthetic oligonucleotide
ccccggcggtcgaacgcgtgcgcca

SEQ ID NO: 732960 - DNA, 25 bp, Artificial sequence
  Synthetic oligonucleotide
ccccggcggtcgtacgcgtgcgcca

SEQ ID NO: 732961 - DNA, 25 bp, Artificial sequence
  Synthetic oligonucleotide
ccgccctatcgccccgcacacccgg

SEQ ID NO: 732962 - DNA, 25 bp, Artificial sequence
  Synthetic oligonucleotide
ccgccctatcgcgccgcacacccgg

SEQ ID NO: 732963 - DNA, 25 bp, Artificial sequence
  Synthetic oligonucleotide
gctgggcgcgtacgcccgaggccgt

SEQ ID NO: 732964 - DNA, 25 bp, Artificial sequence
  Synthetic oligonucleotide
gctgggcgcgtaggcccgaggccgt

SEQ ID NO: 732965 - DNA, 25 bp, Artificial sequence
  Synthetic oligonucleotide
ggcccgcgccgagggtctatcgccc

SEQ ID NO: 732966 - DNA, 25 bp, Artificial sequence
  Synthetic oligonucleotide
ggcgactacgttgggcgccggcgcg

SEQ ID NO: 732967 - DNA, 25 bp, Artificial sequence
  Synthetic oligonucleotide
cggggctcgcgtctacggtccgccc

SEQ ID NO: 732968 - DNA, 25 bp, Artificial sequence
  Synthetic oligonucleotide
cctccgcctatgcgcgacgggccgg

SEQ ID NO: 732969 - DNA, 25 bp, Artificial sequence
  Synthetic oligonucleotide
gcgcgggaccggttacgcgccaggg

SEQ ID NO: 732970 - DNA, 25 bp, Artificial sequence
  Synthetic oligonucleotide
gcgcgggaccggatacgcgccaggg

SEQ ID NO: 732971 - DNA, 25 bp, Artificial sequence
  Synthetic oligonucleotide
cgcgagtgccgtacgacgggccgcg

SEQ ID NO: 732972 - DNA, 25 bp, Artificial sequence
  Synthetic oligonucleotide
cgcgagtgccgttcgacgggccgcg

SEQ ID NO: 732973 - DNA, 25 bp, Artificial sequence
  Synthetic oligonucleotide
cgcgcccgctagggcgaggacggga

SEQ ID NO: 732974 - DNA, 25 bp, Artificial sequence
  Synthetic oligonucleotide
cgcgcccgctagcgcgaggacggga

SEQ ID NO: 732975 - DNA, 25 bp, Artificial sequence
  Synthetic oligonucleotide
ccgccgcgaccccccgtactggcga

SEQ ID NO: 732976 - DNA, 25 bp, Artificial sequence
  Synthetic oligonucleotide
ccgccgcgacccgccgtactggcga

SEQ ID NO: 732977 - DNA, 25 bp, Artificial sequence
  Synthetic oligonucleotide
ccaccgggtcgctcgcgaacgcgcg

SEQ ID NO: 732978 - DNA, 25 bp, Artificial sequence
  Synthetic oligonucleotide
ccaccgggtcgcacgcgaacgcgcg

SEQ ID NO: 732979 - DNA, 25 bp, Artificial sequence
  Synthetic oligonucleotide
cccgcctggtcgtccgcggacgtcc

SEQ ID NO: 732980 - DNA, 25 bp, Artificial sequence
  Synthetic oligonucleotide
ggcccgcgccgacggtctatcgccc

SEQ ID NO: 732981 - DNA, 25 bp, Artificial sequence
  Synthetic oligonucleotide
gggtagcgcggcctcgagagcccgc

SEQ ID NO: 732982 - DNA, 25 bp, Artificial sequence
  Synthetic oligonucleotide
gcgtccgtgcgaccgcgcaaggccg

SEQ ID NO: 732983 - DNA, 25 bp, Artificial sequence
  Synthetic oligonucleotide
cccgggctatggggcgtcgcctccc

SEQ ID NO: 732984 - DNA, 25 bp, Artificial sequence
  Synthetic oligonucleotide
cccgggctatggcgcgtcgcctccc

SEQ ID NO: 732985 - DNA, 25 bp, Artificial sequence
  Synthetic oligonucleotide
ccacagcgacgcgtagccgggggcc

SEQ ID NO: 732986 - DNA, 25 bp, Artificial sequence
  Synthetic oligonucleotide
ccacagcgacgcctagccgggggcc

SEQ ID NO: 732987 - DNA, 25 bp, Artificial sequence
  Synthetic oligonucleotide
ggggccgcgtccgcgtcgacgtgag

SEQ ID NO: 732988 - DNA, 25 bp, Artificial sequence
  Synthetic oligonucleotide
ggggccgcgtccccgtcgacgtgag

SEQ ID NO: 732989 - DNA, 25 bp, Artificial sequence
  Synthetic oligonucleotide
tacgccgcccgaagtcgcgggggcg

SEQ ID NO: 732990 - DNA, 25 bp, Artificial sequence
  Synthetic oligonucleotide
tacgccgcccgatgtcgcgggggcg

SEQ ID NO: 732991 - DNA, 25 bp, Artificial sequence
  Synthetic oligonucleotide
cgtggccgtacggccgtgcagcggg

SEQ ID NO: 732992 - DNA, 25 bp, Artificial sequence
  Synthetic oligonucleotide
ccaccctcgtaccggcgtcgccgcg

SEQ ID NO: 732993 - DNA, 25 bp, Artificial sequence
  Synthetic oligonucleotide
gggtagcgcggcgtcgagagcccgc

SEQ ID NO: 732994 - DNA, 25 bp, Artificial sequence
  Synthetic oligonucleotide
ggtgggcggtcgatcccgcaccggg

SEQ ID NO: 732995 - DNA, 25 bp, Artificial sequence
  Synthetic oligonucleotide
tcgggcgcggttcgcgcctccccga

SEQ ID NO: 732996 - DNA, 25 bp, Artificial sequence
  Synthetic oligonucleotide
tcgggcgcggttggcgcctccccga

SEQ ID NO: 732997 - DNA, 25 bp, Artificial sequence
  Synthetic oligonucleotide
aggagcgtcgcgcaaccggcgcggg

SEQ ID NO: 732998 - DNA, 25 bp, Artificial sequence
  Synthetic oligonucleotide
aggagcgtcgcggaaccggcgcggg

SEQ ID NO: 732999 - DNA, 25 bp, Artificial sequence
  Synthetic oligonucleotide
cccagagcggccggtcgatcccggg

SEQ ID NO: 733000 - DNA, 25 bp, Artificial sequence
  Synthetic oligonucleotide
cccagagcggcccgtcgatcccggg

SEQ ID NO: 733001 - DNA, 25 bp, Artificial sequence
  Synthetic oligonucleotide
ggcggcacgacgtagcgcgggcacg

SEQ ID NO: 733002 - DNA, 25 bp, Artificial sequence
  Synthetic oligonucleotide
ggcggcacgacgaagcgcgggcacg

SEQ ID NO: 733003 - DNA, 25 bp, Artificial sequence
  Synthetic oligonucleotide
cgctcctcgcccgacggggaggcga

SEQ ID NO: 733004 - DNA, 25 bp, Artificial sequence
  Synthetic oligonucleotide
cgtcggatacggcgcgcgtccgcgc

SEQ ID NO: 733005 - DNA, 25 bp, Artificial sequence
  Synthetic oligonucleotide
cgtggccgtacgcccgtgcagcggg

SEQ ID NO: 733006 - DNA, 25 bp, Artificial sequence
  Synthetic oligonucleotide
ccgcagcgatcgtcacggggcgccc

SEQ ID NO: 733007 - DNA, 25 bp, Artificial sequence
  Synthetic oligonucleotide
gtcggcggcgtagcgtacggccgcg

SEQ ID NO: 733008 - DNA, 25 bp, Artificial sequence
  Synthetic oligonucleotide
gtcggcggcgtaccgtacggccgcg

SEQ ID NO: 733009 - DNA, 25 bp, Artificial sequence
  Synthetic oligonucleotide
agacggcggacccgcgtacggccgc

SEQ ID NO: 733010 - DNA, 25 bp, Artificial sequence
  Synthetic oligonucleotide
agacggcggaccggcgtacggccgc

SEQ ID NO: 733011 - DNA, 25 bp, Artificial sequence
  Synthetic oligonucleotide
gcccgacgcgcgagtaccgtggggc

SEQ ID NO: 733012 - DNA, 25 bp, Artificial sequence
  Synthetic oligonucleotide
gcccgacgcgcgtgtaccgtggggc

SEQ ID NO: 733013 - DNA, 25 bp, Artificial sequence
  Synthetic oligonucleotide
gccactccgcgtagcggcaggccgg

SEQ ID NO: 733014 - DNA, 25 bp, Artificial sequence
  Synthetic oligonucleotide
gccactccgcgttgcggcaggccgg

SEQ ID NO: 733015 - DNA, 25 bp, Artificial sequence
  Synthetic oligonucleotide
gggccgcgcgacctacgcgacctcg

SEQ ID NO: 733016 - DNA, 25 bp, Artificial sequence
  Synthetic oligonucleotide
gggccgcgcgacgtacgcgacctcg

SEQ ID NO: 733017 - DNA, 25 bp, Artificial sequence
  Synthetic oligonucleotide
ccaccctcgtacgggcgtcgccgcg

SEQ ID NO: 733018 - DNA, 25 bp, Artificial sequence
  Synthetic oligonucleotide
gcggcctacgcaggacgggcgccct

SEQ ID NO: 733019 - DNA, 25 bp, Artificial sequence
  Synthetic oligonucleotide
gcgtccgtgcgagcgcgcaaggccg

SEQ ID NO: 733020 - DNA, 25 bp, Artificial sequence
  Synthetic oligonucleotide
ccgcagcgatcgacacggggcgccc

SEQ ID NO: 733021 - DNA, 25 bp, Artificial sequence
  Synthetic oligonucleotide
cccggctcgtgcccgcgaaagggcg

SEQ ID NO: 733022 - DNA, 25 bp, Artificial sequence
  Synthetic oligonucleotide
cccggctcgtgcgcgcgaaagggcg

SEQ ID NO: 733023 - DNA, 25 bp, Artificial sequence
  Synthetic oligonucleotide
cggtgccggtcgggccgtagggcca

SEQ ID NO: 733024 - DNA, 25 bp, Artificial sequence
  Synthetic oligonucleotide
cggtgccggtcgcgccgtagggcca

SEQ ID NO: 733025 - DNA, 25 bp, Artificial sequence
  Synthetic oligonucleotide
tgcctctccgcgctccgacggcggg

SEQ ID NO: 733026 - DNA, 25 bp, Artificial sequence
  Synthetic oligonucleotide
tgcctctccgcggtccgacggcggg

SEQ ID NO: 733027 - DNA, 25 bp, Artificial sequence
  Synthetic oligonucleotide
gcgtgggacccgggtaccgggcacg

SEQ ID NO: 733028 - DNA, 25 bp, Artificial sequence
  Synthetic oligonucleotide
gcgtgggacccgcgtaccgggcacg

SEQ ID NO: 733029 - DNA, 25 bp, Artificial sequence
  Synthetic oligonucleotide
ggtgggcggtcgttcccgcaccggg

SEQ ID NO: 733030 - DNA, 25 bp, Artificial sequence
  Synthetic oligonucleotide
gcggcctacgcacgacgggcgccct

SEQ ID NO: 733031 - DNA, 25 bp, Artificial sequence
  Synthetic oligonucleotide
cgggtctcaaacgggcgcgcccgcg

SEQ ID NO: 733032 - DNA, 25 bp, Artificial sequence
  Synthetic oligonucleotide
cgctcctcgccccacggggaggcga

SEQ ID NO: 733033 - DNA, 25 bp, Artificial sequence
  Synthetic oligonucleotide
gctcgggtcgcggcgaactcggggg

SEQ ID NO: 733034 - DNA, 25 bp, Artificial sequence
  Synthetic oligonucleotide
gctcgggtcgcgccgaactcggggg

SEQ ID NO: 733035 - DNA, 25 bp, Artificial sequence
  Synthetic oligonucleotide
gtggcggcacgcgcgatagccggcg

SEQ ID NO: 733036 - DNA, 25 bp, Artificial sequence
  Synthetic oligonucleotide
gtggcggcacgcccgatagccggcg

SEQ ID NO: 733037 - DNA, 25 bp, Artificial sequence
  Synthetic oligonucleotide
cggccggtcgcaacgggccggagct

SEQ ID NO: 733038 - DNA, 25 bp, Artificial sequence
  Synthetic oligonucleotide
cggccggtcgcatcgggccggagct

SEQ ID NO: 733039 - DNA, 25 bp, Artificial sequence
  Synthetic oligonucleotide
cacggacgtgtccaccggcggccgg

SEQ ID NO: 733040 - DNA, 25 bp, Artificial sequence
  Synthetic oligonucleotide
cacggacgtgtcgaccggcggccgg

SEQ ID NO: 733041 - DNA, 25 bp, Artificial sequence
  Synthetic oligonucleotide
tgcgcgcgcgacaactcgggcgccg

SEQ ID NO: 733042 - DNA, 25 bp, Artificial sequence
  Synthetic oligonucleotide
ggcggccgaagccgaccgtgcccgt

SEQ ID NO: 733043 - DNA, 25 bp, Artificial sequence
  Synthetic oligonucleotide
cgggtctcaaaccggcgcgcccgcg

SEQ ID NO: 733044 - DNA, 25 bp, Artificial sequence
  Synthetic oligonucleotide
gcccgcacacaccgcgtcggacggc

SEQ ID NO: 733045 - DNA, 25 bp, Artificial sequence
  Synthetic oligonucleotide
ggccacacgctaggcgtcggcccgc

SEQ ID NO: 733046 - DNA, 25 bp, Artificial sequence
  Synthetic oligonucleotide
ggccacacgctacgcgtcggcccgc

SEQ ID NO: 733047 - DNA, 25 bp, Artificial sequence
  Synthetic oligonucleotide
gcaccccgcgcgactcgtccggctc

SEQ ID NO: 733048 - DNA, 25 bp, Artificial sequence
  Synthetic oligonucleotide
gcaccccgcgcgtctcgtccggctc

SEQ ID NO: 733049 - DNA, 25 bp, Artificial sequence
  Synthetic oligonucleotide
gcagcccgacccctgtcggcggcgt

SEQ ID NO: 733050 - DNA, 25 bp, Artificial sequence
  Synthetic oligonucleotide
gcagcccgacccgtgtcggcggcgt

SEQ ID NO: 733051 - DNA, 25 bp, Artificial sequence
  Synthetic oligonucleotide
ggctccgtcgagcgcacggtggccg

SEQ ID NO: 733052 - DNA, 25 bp, Artificial sequence
  Synthetic oligonucleotide
ggctccgtcgagggcacggtggccg

SEQ ID NO: 733053 - DNA, 25 bp, Artificial sequence
  Synthetic oligonucleotide
gcgcgcacgcgttagaccgccgcgg

SEQ ID NO: 733054 - DNA, 25 bp, Artificial sequence
  Synthetic oligonucleotide
gcgtgccgcgtccaccggtcgccgt

SEQ ID NO: 733055 - DNA, 25 bp, Artificial sequence
  Synthetic oligonucleotide
cctcgcaccggcctccgaacgcgcc

SEQ ID NO: 733056 - DNA, 25 bp, Artificial sequence
  Synthetic oligonucleotide
ccaccccgacgcgtatccgcgggcg

SEQ ID NO: 733057 - DNA, 25 bp, Artificial sequence
  Synthetic oligonucleotide
cgcgctcgggcccgtacgacccacc

SEQ ID NO: 733058 - DNA, 25 bp, Artificial sequence
  Synthetic oligonucleotide
cgcgctcgggccggtacgacccacc

SEQ ID NO: 733059 - DNA, 25 bp, Artificial sequence
  Synthetic oligonucleotide
cgggtctgcgccctgacgcgcgcga

SEQ ID NO: 733060 - DNA, 25 bp, Artificial sequence
  Synthetic oligonucleotide
cgggtctgcgccgtgacgcgcgcga

SEQ ID NO: 733061 - DNA, 25 bp, Artificial sequence
  Synthetic oligonucleotide
ccctccggccggtcgcgtacagcgg

SEQ ID NO: 733062 - DNA, 25 bp, Artificial sequence
  Synthetic oligonucleotide
ccctccggccggacgcgtacagcgg

SEQ ID NO: 733063 - DNA, 25 bp, Artificial sequence
  Synthetic oligonucleotide
gtggcccccgatagcggtcggcggc

SEQ ID NO: 733064 - DNA, 25 bp, Artificial sequence
  Synthetic oligonucleotide
gtggcccccgattgcggtcggcggc

SEQ ID NO: 733065 - DNA, 25 bp, Artificial sequence
  Synthetic oligonucleotide
caggaccggacgggcgttccgcccc

SEQ ID NO: 733066 - DNA, 25 bp, Artificial sequence
  Synthetic oligonucleotide
caggaccggacgcgcgttccgcccc

SEQ ID NO: 733067 - DNA, 25 bp, Artificial sequence
  Synthetic oligonucleotide
ggcggccgaagcggaccgtgcccgt

SEQ ID NO: 733068 - DNA, 25 bp, Artificial sequence
  Synthetic oligonucleotide
ccttggccgtaacgcgcgcgcgccc

SEQ ID NO: 733069 - DNA, 25 bp, Artificial sequence
  Synthetic oligonucleotide
tgcgcgcgcgactactcgggcgccg

SEQ ID NO: 733070 - DNA, 25 bp, Artificial sequence
  Synthetic oligonucleotide
ccaccccgacgcctatccgcgggcg

SEQ ID NO: 733071 - DNA, 25 bp, Artificial sequence
  Synthetic oligonucleotide
cgccgcggacgttcgtccgccagcg

SEQ ID NO: 733072 - DNA, 25 bp, Artificial sequence
  Synthetic oligonucleotide
cgccgcggacgtacgtccgccagcg

SEQ ID NO: 733073 - DNA, 25 bp, Artificial sequence
  Synthetic oligonucleotide
ggccccacgcggtgtatgccccggg

SEQ ID NO: 733074 - DNA, 25 bp, Artificial sequence
  Synthetic oligonucleotide
ggccccacgcggagtatgccccggg

SEQ ID NO: 733075 - DNA, 25 bp, Artificial sequence
  Synthetic oligonucleotide
gctcaccgcgcgacgatggggcccg

SEQ ID NO: 733076 - DNA, 25 bp, Artificial sequence
  Synthetic oligonucleotide
gctcaccgcgcgtcgatggggcccg

SEQ ID NO: 733077 - DNA, 25 bp, Artificial sequence
  Synthetic oligonucleotide
ccccgacgggcgggagtagcgcacg

SEQ ID NO: 733078 - DNA, 25 bp, Artificial sequence
  Synthetic oligonucleotide
ccccgacgggcgcgagtagcgcacg

SEQ ID NO: 733079 - DNA, 25 bp, Artificial sequence
  Synthetic oligonucleotide
gcccgcacacacggcgtcggacggc

SEQ ID NO: 733080 - DNA, 25 bp, Artificial sequence
  Synthetic oligonucleotide
ccttggccgtaaggcgcgcgcgccc

SEQ ID NO: 733081 - DNA, 25 bp, Artificial sequence
  Synthetic oligonucleotide
ctcgcgggggtacgcgatccggcgg

SEQ ID NO: 733082 - DNA, 25 bp, Artificial sequence
  Synthetic oligonucleotide
gggcgccgtcgcgcatctaccggcg

SEQ ID NO: 733083 - DNA, 25 bp, Artificial sequence
  Synthetic oligonucleotide
cgcgtgccgcgacacgcgtcctgcc

SEQ ID NO: 733084 - DNA, 25 bp, Artificial sequence
  Synthetic oligonucleotide
gccccggggtaccacgcggccatcg

SEQ ID NO: 733085 - DNA, 25 bp, Artificial sequence
  Synthetic oligonucleotide
gccccggggtacgacgcggccatcg

SEQ ID NO: 733086 - DNA, 25 bp, Artificial sequence
  Synthetic oligonucleotide
gcgcttcgcacgacgaccgcggccg

SEQ ID NO: 733087 - DNA, 25 bp, Artificial sequence
  Synthetic oligonucleotide
gcgcttcgcacgtcgaccgcggccg

SEQ ID NO: 733088 - DNA, 25 bp, Artificial sequence
  Synthetic oligonucleotide
gcgcgggccggcctaagcgcggaga

SEQ ID NO: 733089 - DNA, 25 bp, Artificial sequence
  Synthetic oligonucleotide
gcgcgggccggcgtaagcgcggaga

SEQ ID NO: 733090 - DNA, 25 bp, Artificial sequence
  Synthetic oligonucleotide
cgcgctgcgtacgccgtcgcgcagg

SEQ ID NO: 733091 - DNA, 25 bp, Artificial sequence
  Synthetic oligonucleotide
cgcgctgcgtaccccgtcgcgcagg

SEQ ID NO: 733092 - DNA, 25 bp, Artificial sequence
  Synthetic oligonucleotide
acggcgcggtcgagctacgcgccgg

SEQ ID NO: 733093 - DNA, 25 bp, Artificial sequence
  Synthetic oligonucleotide
gcaggcggtcgcctgacggcccctg

SEQ ID NO: 733094 - DNA, 25 bp, Artificial sequence
  Synthetic oligonucleotide
acggcgcggtcgtgctacgcgccgg

SEQ ID NO: 733095 - DNA, 25 bp, Artificial sequence
  Synthetic oligonucleotide
ctcgcgggggtaggcgatccggcgg

SEQ ID NO: 733096 - DNA, 25 bp, Artificial sequence
  Synthetic oligonucleotide
gcccggcgaggccgtccgtacccag

SEQ ID NO: 733097 - DNA, 25 bp, Artificial sequence
  Synthetic oligonucleotide
gcccggcgaggcggtccgtacccag

SEQ ID NO: 733098 - DNA, 25 bp, Artificial sequence
  Synthetic oligonucleotide
ggcctgccgacgcaccggtccgtgc

SEQ ID NO: 733099 - DNA, 25 bp, Artificial sequence
  Synthetic oligonucleotide
ggcctgccgacggaccggtccgtgc

SEQ ID NO: 733100 - DNA, 25 bp, Artificial sequence
  Synthetic oligonucleotide
tgagcccgacccctcggtcgcgcgg

SEQ ID NO: 733101 - DNA, 25 bp, Artificial sequence
  Synthetic oligonucleotide
tgagcccgacccgtcggtcgcgcgg

SEQ ID NO: 733102 - DNA, 25 bp, Artificial sequence
  Synthetic oligonucleotide
cctgccggccggaatagcgcgcccc

SEQ ID NO: 733103 - DNA, 25 bp, Artificial sequence
  Synthetic oligonucleotide
cctgccggccggtatagcgcgcccc

SEQ ID NO: 733104 - DNA, 25 bp, Artificial sequence
  Synthetic oligonucleotide
gggcgccgtcgcccatctaccggcg

SEQ ID NO: 733105 - DNA, 25 bp, Artificial sequence
  Synthetic oligonucleotide
gcaggcggtcgcgtgacggcccctg

SEQ ID NO: 733106 - DNA, 25 bp, Artificial sequence
  Synthetic oligonucleotide
ggccgggcgcgtagcggtactggcc

SEQ ID NO: 733107 - DNA, 25 bp, Artificial sequence
  Synthetic oligonucleotide
gcgcgcacgcgtaagaccgccgcgg

SEQ ID NO: 733108 - DNA, 25 bp, Artificial sequence
  Synthetic oligonucleotide
gcggccacggaccgtcggccgtcga

SEQ ID NO: 733109 - DNA, 25 bp, Artificial sequence
  Synthetic oligonucleotide
cctcgcaccggcgtccgaacgcgcc

SEQ ID NO: 733110 - DNA, 25 bp, Artificial sequence
  Synthetic oligonucleotide
cgtcggatacggggcgcgtccgcgc

SEQ ID NO: 733111 - DNA, 25 bp, Artificial sequence
  Synthetic oligonucleotide
gcggccacggacggtcggccgtcga

SEQ ID NO: 733112 - DNA, 25 bp, Artificial sequence
  Synthetic oligonucleotide
gcacgccgacggaagccgggctggc

SEQ ID NO: 733113 - DNA, 25 bp, Artificial sequence
  Synthetic oligonucleotide
gcacgccgacggtagccgggctggc

SEQ ID NO: 733114 - DNA, 25 bp, Artificial sequence
  Synthetic oligonucleotide
ccgcgactgtcgcgcgacgggccgt

SEQ ID NO: 733115 - DNA, 25 bp, Artificial sequence
  Synthetic oligonucleotide
cgcccgcccggtagcgacgctgtgg

SEQ ID NO: 733116 - DNA, 25 bp, Artificial sequence
  Synthetic oligonucleotide
gggcggacggtaaccggcgcaggcc

SEQ ID NO: 733117 - DNA, 25 bp, Artificial sequence
  Synthetic oligonucleotide
cgcgtgccgcgagacgcgtcctgcc

SEQ ID NO: 733118 - DNA, 25 bp, Artificial sequence
  Synthetic oligonucleotide
ggccgggcgcgttgcggtactggcc

SEQ ID NO: 733119 - DNA, 25 bp, Artificial sequence
  Synthetic oligonucleotide
cgcccgcccggttgcgacgctgtgg

SEQ ID NO: 733120 - DNA, 25 bp, Artificial sequence
  Synthetic oligonucleotide
gcccggggtctaggcgcgtcgggtg

SEQ ID NO: 733121 - DNA, 25 bp, Artificial sequence
  Synthetic oligonucleotide
gcccggggtctacgcgcgtcgggtg

SEQ ID NO: 733122 - DNA, 25 bp, Artificial sequence
  Synthetic oligonucleotide
ccccggcgcgattgacgccgctgcc

SEQ ID NO: 733123 - DNA, 25 bp, Artificial sequence
  Synthetic oligonucleotide
ccccggcgcgatagacgccgctgcc

SEQ ID NO: 733124 - DNA, 25 bp, Artificial sequence
  Synthetic oligonucleotide
cggtccgggcgcctaagccccagcg

SEQ ID NO: 733125 - DNA, 25 bp, Artificial sequence
  Synthetic oligonucleotide
cggtccgggcgcgtaagccccagcg

SEQ ID NO: 733126 - DNA, 25 bp, Artificial sequence
  Synthetic oligonucleotide
gcggcgtaccggacgacgcgctgcg

SEQ ID NO: 733127 - DNA, 25 bp, Artificial sequence
  Synthetic oligonucleotide
gcggcgtaccggtcgacgcgctgcg

SEQ ID NO: 733128 - DNA, 25 bp, Artificial sequence
  Synthetic oligonucleotide
ccaggccgcgcttcccgatcggggg

SEQ ID NO: 733129 - DNA, 25 bp, Artificial sequence
  Synthetic oligonucleotide
ccaggccgcgctacccgatcggggg

SEQ ID NO: 733130 - DNA, 25 bp, Artificial sequence
  Synthetic oligonucleotide
gggcggacggtatccggcgcaggcc

SEQ ID NO: 733131 - DNA, 25 bp, Artificial sequence
  Synthetic oligonucleotide
gacgcgcgcgcaacgaccggcctcc

SEQ ID NO: 733132 - DNA, 25 bp, Artificial sequence
  Synthetic oligonucleotide
tcgtcgccggcataccgcgcccgcg

SEQ ID NO: 733133 - DNA, 25 bp, Artificial sequence
  Synthetic oligonucleotide
ggctggcggacgatcgtgcccgcgg

SEQ ID NO: 733134 - DNA, 25 bp, Artificial sequence
  Synthetic oligonucleotide
ggctggcggacgttcgtgcccgcgg

SEQ ID NO: 733135 - DNA, 25 bp, Artificial sequence
  Synthetic oligonucleotide
cctgccggttcgtcgcgacgcgccc

SEQ ID NO: 733136 - DNA, 25 bp, Artificial sequence
  Synthetic oligonucleotide
cctgccggttcgacgcgacgcgccc

SEQ ID NO: 733137 - DNA, 25 bp, Artificial sequence
  Synthetic oligonucleotide
tacgccgctagcgcggacgcggcgg

SEQ ID NO: 733138 - DNA, 25 bp, Artificial sequence
  Synthetic oligonucleotide
tacgccgctagcccggacgcggcgg

SEQ ID NO: 733139 - DNA, 25 bp, Artificial sequence
  Synthetic oligonucleotide
gcggcgccgccgtatcgcgcagcct

SEQ ID NO: 733140 - DNA, 25 bp, Artificial sequence
  Synthetic oligonucleotide
gcggcgccgccgaatcgcgcagcct

SEQ ID NO: 733141 - DNA, 25 bp, Artificial sequence
  Synthetic oligonucleotide
ccgcggagtacgtaccgcgcgggcc

SEQ ID NO: 733142 - DNA, 25 bp, Artificial sequence
  Synthetic oligonucleotide
tcgtcgccggcaaaccgcgcccgcg

SEQ ID NO: 733143 - DNA, 25 bp, Artificial sequence
  Synthetic oligonucleotide
gacgcgcgcgcatcgaccggcctcc

SEQ ID NO: 733144 - DNA, 25 bp, Artificial sequence
  Synthetic oligonucleotide
cgcagccgggcgcgaaacaggcgcg

SEQ ID NO: 733145 - DNA, 25 bp, Artificial sequence
  Synthetic oligonucleotide
gagcggcgtagcctaggcgggcccc

SEQ ID NO: 733146 - DNA, 25 bp, Artificial sequence
  Synthetic oligonucleotide
gagcggcgtagcgtaggcgggcccc

SEQ ID NO: 733147 - DNA, 25 bp, Artificial sequence
  Synthetic oligonucleotide
cgcagccgggcgggaaacaggcgcg

SEQ ID NO: 733148 - DNA, 25 bp, Artificial sequence
  Synthetic oligonucleotide
cggtcgcgtcgcgtatggggggccc

SEQ ID NO: 733149 - DNA, 25 bp, Artificial sequence
  Synthetic oligonucleotide
cggtcgcgtcgcctatggggggccc

SEQ ID NO: 733150 - DNA, 25 bp, Artificial sequence
  Synthetic oligonucleotide
tcgggcggcttacgcgcggcctccg

SEQ ID NO: 733151 - DNA, 25 bp, Artificial sequence
  Synthetic oligonucleotide
tcgggcggcttaggcgcggcctccg

SEQ ID NO: 733152 - DNA, 25 bp, Artificial sequence
  Synthetic oligonucleotide
gggtcgccgaacgcggtcgagcgcc

SEQ ID NO: 733153 - DNA, 25 bp, Artificial sequence
  Synthetic oligonucleotide
ccgcgactgtcgggcgacgggccgt

SEQ ID NO: 733154 - DNA, 25 bp, Artificial sequence
  Synthetic oligonucleotide
ggccagtcgcgaggtaccggcgcgc

SEQ ID NO: 733155 - DNA, 25 bp, Artificial sequence
  Synthetic oligonucleotide
ggccagtcgcgacgtaccggcgcgc

SEQ ID NO: 733156 - DNA, 25 bp, Artificial sequence
  Synthetic oligonucleotide
ccgcggagtacgaaccgcgcgggcc

SEQ ID NO: 733157 - DNA, 25 bp, Artificial sequence
  Synthetic oligonucleotide
tcccgccgcgtacggggcacgcgca

SEQ ID NO: 733158 - DNA, 25 bp, Artificial sequence
  Synthetic oligonucleotide
agcggggcgcgagcgtctacggcgc

SEQ ID NO: 733159 - DNA, 25 bp, Artificial sequence
  Synthetic oligonucleotide
agcgcctcgtaccggcgtgccgcgg

SEQ ID NO: 733160 - DNA, 25 bp, Artificial sequence
  Synthetic oligonucleotide
ggcgcgctcggcgcgtacgtctggc

SEQ ID NO: 733161 - DNA, 25 bp, Artificial sequence
  Synthetic oligonucleotide
cgggccgacgtcgcgcgtaccggca

SEQ ID NO: 733162 - DNA, 25 bp, Artificial sequence
  Synthetic oligonucleotide
cgggccgacgtcccgcgtaccggca

SEQ ID NO: 733163 - DNA, 25 bp, Artificial sequence
  Synthetic oligonucleotide
ggcgcgctcggcccgtacgtctggc

SEQ ID NO: 733164 - DNA, 25 bp, Artificial sequence
  Synthetic oligonucleotide
agcggggcgcgaccgtctacggcgc

SEQ ID NO: 733165 - DNA, 25 bp, Artificial sequence
  Synthetic oligonucleotide
tcccgccgcgtagggggcacgcgca

SEQ ID NO: 733166 - DNA, 25 bp, Artificial sequence
  Synthetic oligonucleotide
gggtcgccgaacccggtcgagcgcc

SEQ ID NO: 733167 - DNA, 25 bp, Artificial sequence
  Synthetic oligonucleotide
gccgcccgtatgcgcgccgcttgcc

SEQ ID NO: 733168 - DNA, 25 bp, Artificial sequence
  Synthetic oligonucleotide
gccgcccgtatgggcgccgcttgcc

SEQ ID NO: 733169 - DNA, 25 bp, Artificial sequence
  Synthetic oligonucleotide
aggccggtcgacgtccgcgcagcgc

SEQ ID NO: 733170 - DNA, 25 bp, Artificial sequence
  Synthetic oligonucleotide
aggccggtcgacctccgcgcagcgc

SEQ ID NO: 733171 - DNA, 25 bp, Artificial sequence
  Synthetic oligonucleotide
aggggctcggacgggccgtgctccc

SEQ ID NO: 733172 - DNA, 25 bp, Artificial sequence
  Synthetic oligonucleotide
cggagcgcggcggaacgtccggacc

SEQ ID NO: 733173 - DNA, 25 bp, Artificial sequence
  Synthetic oligonucleotide
aggcgctaccgccgagcggcgaggg

SEQ ID NO: 733174 - DNA, 25 bp, Artificial sequence
  Synthetic oligonucleotide
ccggcgcgctacgggcgactcgagg

SEQ ID NO: 733175 - DNA, 25 bp, Artificial sequence
  Synthetic oligonucleotide
aggcgctaccgcggagcggcgaggg

SEQ ID NO: 733176 - DNA, 25 bp, Artificial sequence
  Synthetic oligonucleotide
aggggctcggaccggccgtgctccc

SEQ ID NO: 733177 - DNA, 25 bp, Artificial sequence
  Synthetic oligonucleotide
cggtccgcgctagcgcaccgcggtg

SEQ ID NO: 733178 - DNA, 25 bp, Artificial sequence
  Synthetic oligonucleotide
cggtccgcgctaccgcaccgcggtg

SEQ ID NO: 733179 - DNA, 25 bp, Artificial sequence
  Synthetic oligonucleotide
cggagcgcggcgcaacgtccggacc

SEQ ID NO: 733180 - DNA, 25 bp, Artificial sequence
  Synthetic oligonucleotide
agcgcctcgtacgggcgtgccgcgg

SEQ ID NO: 733181 - DNA, 25 bp, Artificial sequence
  Synthetic oligonucleotide
ccggcgcgctaccggcgactcgagg

SEQ ID NO: 733182 - DNA, 25 bp, Artificial sequence
  Synthetic oligonucleotide
ggcgcgacggtcgcgggtagccccc

SEQ ID NO: 733183 - DNA, 25 bp, Artificial sequence
  Synthetic oligonucleotide
ggcgcgacggtcccgggtagccccc

SEQ ID NO: 733184 - DNA, 25 bp, Artificial sequence
  Synthetic oligonucleotide
cgcggcaccggggcgtacggctccg

SEQ ID NO: 733185 - DNA, 25 bp, Artificial sequence
  Synthetic oligonucleotide
cgcggcaccgggccgtacggctccg

SEQ ID NO: 733186 - DNA, 25 bp, Artificial sequence
  Synthetic oligonucleotide
cccctggcgcgagcctacggggcgc

SEQ ID NO: 733187 - DNA, 25 bp, Artificial sequence
  Synthetic oligonucleotide
cccctggcgcgaccctacggggcgc

SEQ ID NO: 733188 - DNA, 25 bp, Artificial sequence
  Synthetic oligonucleotide
ccggcgcgcccgggcgataggtggg

SEQ ID NO: 733189 - DNA, 25 bp, Artificial sequence
  Synthetic oligonucleotide
ccggcgcgcccgcgcgataggtggg

SEQ ID NO: 733190 - DNA, 25 bp, Artificial sequence
  Synthetic oligonucleotide
cggccctatgcgggccgcggccacg

SEQ ID NO: 733191 - DNA, 25 bp, Artificial sequence
  Synthetic oligonucleotide
cggccctatgcgcgccgcggccacg

SEQ ID NO: 733192 - DNA, 25 bp, Artificial sequence
  Synthetic oligonucleotide
ggccgaaccggtcgacgcgggccgc

SEQ ID NO: 733193 - DNA, 25 bp, Artificial sequence
  Synthetic oligonucleotide
gacgcgctcccggtacgcgcgcccg

SEQ ID NO: 733194 - DNA, 25 bp, Artificial sequence
  Synthetic oligonucleotide
cgcggctcgccgctaggcgccgtgc

SEQ ID NO: 733195 - DNA, 25 bp, Artificial sequence
  Synthetic oligonucleotide
cgcggctcgccggtaggcgccgtgc

SEQ ID NO: 733196 - DNA, 25 bp, Artificial sequence
  Synthetic oligonucleotide
ggccgaaccggtggacgcgggccgc

SEQ ID NO: 733197 - DNA, 25 bp, Artificial sequence
  Synthetic oligonucleotide
gcgcagcgcacgttcgcggcgcggg

SEQ ID NO: 733198 - DNA, 25 bp, Artificial sequence
  Synthetic oligonucleotide
cgcggggcgacctctcgcgggcgct

SEQ ID NO: 733199 - DNA, 25 bp, Artificial sequence
  Synthetic oligonucleotide
cgcggggcgaccactcgcgggcgct

SEQ ID NO: 733200 - DNA, 25 bp, Artificial sequence
  Synthetic oligonucleotide
gacgcgctcccgctacgcgcgcccg

SEQ ID NO: 733201 - DNA, 25 bp, Artificial sequence
  Synthetic oligonucleotide
cccgcgcgtcccgacgtcggcggct

SEQ ID NO: 733202 - DNA, 25 bp, Artificial sequence
  Synthetic oligonucleotide
gccggtgcgcggacgtgtccgcgcc

SEQ ID NO: 733203 - DNA, 25 bp, Artificial sequence
  Synthetic oligonucleotide
ggcgcgcgcgtggcgactaccggcg

SEQ ID NO: 733204 - DNA, 25 bp, Artificial sequence
  Synthetic oligonucleotide
ggcgcgcgcgtgccgactaccggcg

SEQ ID NO: 733205 - DNA, 25 bp, Artificial sequence
  Synthetic oligonucleotide
ggcgggtaggccggcgcgtgcgcga

SEQ ID NO: 733206 - DNA, 25 bp, Artificial sequence
  Synthetic oligonucleotide
gcgcagcgcacgatcgcggcgcggg

SEQ ID NO: 733207 - DNA, 25 bp, Artificial sequence
  Synthetic oligonucleotide
ccgcccccctggttcggcgcgaggc

SEQ ID NO: 733208 - DNA, 25 bp, Artificial sequence
  Synthetic oligonucleotide
cggcgcgggcggaacggtcgcacgg

SEQ ID NO: 733209 - DNA, 25 bp, Artificial sequence
  Synthetic oligonucleotide
cggcgcgggcggtacggtcgcacgg

SEQ ID NO: 733210 - DNA, 25 bp, Artificial sequence
  Synthetic oligonucleotide
ggcgtgcgtctaggcgcgggggccg

SEQ ID NO: 733211 - DNA, 25 bp, Artificial sequence
  Synthetic oligonucleotide
cgaccctcgacgcgagggccgcggc

SEQ ID NO: 733212 - DNA, 25 bp, Artificial sequence
  Synthetic oligonucleotide
cccgcgcgtccccacgtcggcggct

SEQ ID NO: 733213 - DNA, 25 bp, Artificial sequence
  Synthetic oligonucleotide
gcggcagcccggtgcgacgcgaccc

SEQ ID NO: 733214 - DNA, 25 bp, Artificial sequence
  Synthetic oligonucleotide
cgaccctcgacgggagggccgcggc

SEQ ID NO: 733215 - DNA, 25 bp, Artificial sequence
  Synthetic oligonucleotide
ccgcccccctggatcggcgcgaggc

SEQ ID NO: 733216 - DNA, 25 bp, Artificial sequence
  Synthetic oligonucleotide
gggccctcggacccccgtccggtgc

SEQ ID NO: 733217 - DNA, 25 bp, Artificial sequence
  Synthetic oligonucleotide
gggccctcggacgcccgtccggtgc

SEQ ID NO: 733218 - DNA, 25 bp, Artificial sequence
  Synthetic oligonucleotide
cggcggcgtcgcctagggagggcgc

SEQ ID NO: 733219 - DNA, 25 bp, Artificial sequence
  Synthetic oligonucleotide
cggcggcgtcgcgtagggagggcgc

SEQ ID NO: 733220 - DNA, 25 bp, Artificial sequence
  Synthetic oligonucleotide
aggccccgcgtgggacacggcgggc

SEQ ID NO: 733221 - DNA, 25 bp, Artificial sequence
  Synthetic oligonucleotide
aggccccgcgtgcgacacggcgggc

SEQ ID NO: 733222 - DNA, 25 bp, Artificial sequence
  Synthetic oligonucleotide
gcggcagcccggagcgacgcgaccc

SEQ ID NO: 733223 - DNA, 25 bp, Artificial sequence
  Synthetic oligonucleotide
ggcgtgcgtctacgcgcgggggccg

SEQ ID NO: 733224 - DNA, 25 bp, Artificial sequence
  Synthetic oligonucleotide
ggccgccgacgctccggggcgatgg

SEQ ID NO: 733225 - DNA, 25 bp, Artificial sequence
  Synthetic oligonucleotide
acccgcgcgcgcgatacggggggcc

SEQ ID NO: 733226 - DNA, 25 bp, Artificial sequence
  Synthetic oligonucleotide
acccgcgcgcgccatacggggggcc

SEQ ID NO: 733227 - DNA, 25 bp, Artificial sequence
  Synthetic oligonucleotide
ccccccatgcgttcgggcgcgggcc

SEQ ID NO: 733228 - DNA, 25 bp, Artificial sequence
  Synthetic oligonucleotide
ccccccatgcgtacgggcgcgggcc

SEQ ID NO: 733229 - DNA, 25 bp, Artificial sequence
  Synthetic oligonucleotide
cgccccgccgcgccgtatctccggc

SEQ ID NO: 733230 - DNA, 25 bp, Artificial sequence
  Synthetic oligonucleotide
cgccccgccgcggcgtatctccggc

SEQ ID NO: 733231 - DNA, 25 bp, Artificial sequence
  Synthetic oligonucleotide
ggcgcgcccgacggcgcaaccgcac

SEQ ID NO: 733232 - DNA, 25 bp, Artificial sequence
  Synthetic oligonucleotide
ggcgcgcccgaccgcgcaaccgcac

SEQ ID NO: 733233 - DNA, 25 bp, Artificial sequence
  Synthetic oligonucleotide
agcccctccgcaggacgcgggggcg

SEQ ID NO: 733234 - DNA, 25 bp, Artificial sequence
  Synthetic oligonucleotide
gggcgcctgccgaaacgcgcgcccc

SEQ ID NO: 733235 - DNA, 25 bp, Artificial sequence
  Synthetic oligonucleotide
ggcgggtaggcccgcgcgtgcgcga

SEQ ID NO: 733236 - DNA, 25 bp, Artificial sequence
  Synthetic oligonucleotide
ggccgccgacgcaccggggcgatgg

SEQ ID NO: 733237 - DNA, 25 bp, Artificial sequence
  Synthetic oligonucleotide
ggggcggttcggaccgcggcgagcg

SEQ ID NO: 733238 - DNA, 25 bp, Artificial sequence
  Synthetic oligonucleotide
ggggcggttcggtccgcggcgagcg

SEQ ID NO: 733239 - DNA, 25 bp, Artificial sequence
  Synthetic oligonucleotide
gaggcccggctacgcgcgtggcggc

SEQ ID NO: 733240 - DNA, 25 bp, Artificial sequence
  Synthetic oligonucleotide
gaggcccggctaggcgcgtggcggc

SEQ ID NO: 733241 - DNA, 25 bp, Artificial sequence
  Synthetic oligonucleotide
gccggtgcgcggtcgtgtccgcgcc

SEQ ID NO: 733242 - DNA, 25 bp, Artificial sequence
  Synthetic oligonucleotide
gcggggtaccgcgtcacgggcggcg

SEQ ID NO: 733243 - DNA, 25 bp, Artificial sequence
  Synthetic oligonucleotide
tgcgcgtacgcggcgaccgcgcccg

SEQ ID NO: 733244 - DNA, 25 bp, Artificial sequence
  Synthetic oligonucleotide
tgcgcgtacgcgccgaccgcgcccg

SEQ ID NO: 733245 - DNA, 25 bp, Artificial sequence
  Synthetic oligonucleotide
gggcgcctgccgtaacgcgcgcccc

SEQ ID NO: 733246 - DNA, 25 bp, Artificial sequence
  Synthetic oligonucleotide
ccgcgcggttcgcccgcgtcggagc

SEQ ID NO: 733247 - DNA, 25 bp, Artificial sequence
  Synthetic oligonucleotide
gcgcgataccccccgcgaccccccg

SEQ ID NO: 733248 - DNA, 25 bp, Artificial sequence
  Synthetic oligonucleotide
gggctctgtcggaccgcgggccgcg

SEQ ID NO: 733249 - DNA, 25 bp, Artificial sequence
  Synthetic oligonucleotide
gggctctgtcggtccgcgggccgcg

SEQ ID NO: 733250 - DNA, 25 bp, Artificial sequence
  Synthetic oligonucleotide
cgggtcggtcgtacgcgcggcccgc

SEQ ID NO: 733251 - DNA, 25 bp, Artificial sequence
  Synthetic oligonucleotide
cgggtcggtcgttcgcgcggcccgc

SEQ ID NO: 733252 - DNA, 25 bp, Artificial sequence
  Synthetic oligonucleotide
gccgcaccgcgcgtcgcaagccggc

SEQ ID NO: 733253 - DNA, 25 bp, Artificial sequence
  Synthetic oligonucleotide
gccgcaccgcgcctcgcaagccggc

SEQ ID NO: 733254 - DNA, 25 bp, Artificial sequence
  Synthetic oligonucleotide
gcggggcgtatcgggaccgcccgcg

SEQ ID NO: 733255 - DNA, 25 bp, Artificial sequence
  Synthetic oligonucleotide
gcggggcgtatccggaccgcccgcg

SEQ ID NO: 733256 - DNA, 25 bp, Artificial sequence
  Synthetic oligonucleotide
cgagcggaccgtcggctcgcccggc

SEQ ID NO: 733257 - DNA, 25 bp, Artificial sequence
  Synthetic oligonucleotide
gcgggctcgcgagcgcgcacgctgc

SEQ ID NO: 733258 - DNA, 25 bp, Artificial sequence
  Synthetic oligonucleotide
cgagcggaccgtgggctcgcccggc

SEQ ID NO: 733259 - DNA, 25 bp, Artificial sequence
  Synthetic oligonucleotide
ccgcgcggttcggccgcgtcggagc

SEQ ID NO: 733260 - DNA, 25 bp, Artificial sequence
  Synthetic oligonucleotide
gcggcggcggcccttgcgtggccca

SEQ ID NO: 733261 - DNA, 25 bp, Artificial sequence
  Synthetic oligonucleotide
gcggcggcggccgttgcgtggccca

SEQ ID NO: 733262 - DNA, 25 bp, Artificial sequence
  Synthetic oligonucleotide
gcccgccgaccggactacgcgcccc

SEQ ID NO: 733263 - DNA, 25 bp, Artificial sequence
  Synthetic oligonucleotide
gcccgccgaccgcactacgcgcccc

SEQ ID NO: 733264 - DNA, 25 bp, Artificial sequence
  Synthetic oligonucleotide
gggcgcggtagtcgcgcggaccggc

SEQ ID NO: 733265 - DNA, 25 bp, Artificial sequence
  Synthetic oligonucleotide
gggcgcggtagtggcgcggaccggc

SEQ ID NO: 733266 - DNA, 25 bp, Artificial sequence
  Synthetic oligonucleotide
agcccctccgcacgacgcgggggcg

SEQ ID NO: 733267 - DNA, 25 bp, Artificial sequence
  Synthetic oligonucleotide
gcgcgataccccgcgcgaccccccg

SEQ ID NO: 733268 - DNA, 25 bp, Artificial sequence
  Synthetic oligonucleotide
gcgggctcgcgaccgcgcacgctgc

SEQ ID NO: 733269 - DNA, 25 bp, Artificial sequence
  Synthetic oligonucleotide
ggcgcgctagcgggcgtcggaggcc

SEQ ID NO: 733270 - DNA, 25 bp, Artificial sequence
  Synthetic oligonucleotide
gcggccttcggcgcgctacggccgg

SEQ ID NO: 733271 - DNA, 25 bp, Artificial sequence
  Synthetic oligonucleotide
gcggccttcggcccgctacggccgg

SEQ ID NO: 733272 - DNA, 25 bp, Artificial sequence
  Synthetic oligonucleotide
gggccgcggacgcgtaccgctcccg

SEQ ID NO: 733273 - DNA, 25 bp, Artificial sequence
  Synthetic oligonucleotide
gggccgcggacgggtaccgctcccg

SEQ ID NO: 733274 - DNA, 25 bp, Artificial sequence
  Synthetic oligonucleotide
ggccgctcggtccccggtagccggc

SEQ ID NO: 733275 - DNA, 25 bp, Artificial sequence
  Synthetic oligonucleotide
ggccgctcggtcgccggtagccggc

SEQ ID NO: 733276 - DNA, 25 bp, Artificial sequence
  Synthetic oligonucleotide
gcggcgcccgcgtcgggttgcgcca

SEQ ID NO: 733277 - DNA, 25 bp, Artificial sequence
  Synthetic oligonucleotide
gcggcgcccgcgacgggttgcgcca

SEQ ID NO: 733278 - DNA, 25 bp, Artificial sequence
  Synthetic oligonucleotide
gcccgggcggtcctacgcacgcggg

SEQ ID NO: 733279 - DNA, 25 bp, Artificial sequence
  Synthetic oligonucleotide
gccgcgcgtcgccgcctaccacggg

SEQ ID NO: 733280 - DNA, 25 bp, Artificial sequence
  Synthetic oligonucleotide
gggctgtagaccccccgcgggggcg

SEQ ID NO: 733281 - DNA, 25 bp, Artificial sequence
  Synthetic oligonucleotide
ggcgcgctagcgcgcgtcggaggcc

SEQ ID NO: 733282 - DNA, 25 bp, Artificial sequence
  Synthetic oligonucleotide
aggcggccgaccgttgcgcccggcc

SEQ ID NO: 733283 - DNA, 25 bp, Artificial sequence
  Synthetic oligonucleotide
aggcggccgacccttgcgcccggcc

SEQ ID NO: 733284 - DNA, 25 bp, Artificial sequence
  Synthetic oligonucleotide
ccgcgggtccgcgcatccggccacc

SEQ ID NO: 733285 - DNA, 25 bp, Artificial sequence
  Synthetic oligonucleotide
ccgcgggtccgcccatccggccacc

SEQ ID NO: 733286 - DNA, 25 bp, Artificial sequence
  Synthetic oligonucleotide
gcggggtaccgcctcacgggcggcg

SEQ ID NO: 733287 - DNA, 25 bp, Artificial sequence
  Synthetic oligonucleotide
gcccgggcggtcgtacgcacgcggg

SEQ ID NO: 733288 - DNA, 25 bp, Artificial sequence
  Synthetic oligonucleotide
gcacccacgcgcggttgcgcccgcc

SEQ ID NO: 733289 - DNA, 25 bp, Artificial sequence
  Synthetic oligonucleotide
gccgcgcgtcgcggcctaccacggg

SEQ ID NO: 733290 - DNA, 25 bp, Artificial sequence
  Synthetic oligonucleotide
gcacgcgttcggccgcgtcccggcg

SEQ ID NO: 733291 - DNA, 25 bp, Artificial sequence
  Synthetic oligonucleotide
cgtccgcggcccgacgtacggccgc

SEQ ID NO: 733292 - DNA, 25 bp, Artificial sequence
  Synthetic oligonucleotide
ccccgcggcgtaccccgatgcggcg

SEQ ID NO: 733293 - DNA, 25 bp, Artificial sequence
  Synthetic oligonucleotide
ccggccgcgttccgcgatcgcgggg

SEQ ID NO: 733294 - DNA, 25 bp, Artificial sequence
  Synthetic oligonucleotide
ccggccgcgttcggcgatcgcgggg

SEQ ID NO: 733295 - DNA, 25 bp, Artificial sequence
  Synthetic oligonucleotide
ggggcgtcgacccgcacgccgctgg

SEQ ID NO: 733296 - DNA, 25 bp, Artificial sequence
  Synthetic oligonucleotide
ggggcgtcgaccggcacgccgctgg

SEQ ID NO: 733297 - DNA, 25 bp, Artificial sequence
  Synthetic oligonucleotide
ccagcggtcgaccgcggacggcggc

SEQ ID NO: 733298 - DNA, 25 bp, Artificial sequence
  Synthetic oligonucleotide
ccagcggtcgacggcggacggcggc

SEQ ID NO: 733299 - DNA, 25 bp, Artificial sequence
  Synthetic oligonucleotide
cccgccacgcgcgtacggcaccgcg

SEQ ID NO: 733300 - DNA, 25 bp, Artificial sequence
  Synthetic oligonucleotide
gccccgctacggtgacgcggccggc

SEQ ID NO: 733301 - DNA, 25 bp, Artificial sequence
  Synthetic oligonucleotide
cccgccacgcgcctacggcaccgcg

SEQ ID NO: 733302 - DNA, 25 bp, Artificial sequence
  Synthetic oligonucleotide
gcacgcgttcgggcgcgtcccggcg

SEQ ID NO: 733303 - DNA, 25 bp, Artificial sequence
  Synthetic oligonucleotide
gcggccggatacccgcgggcagggc

SEQ ID NO: 733304 - DNA, 25 bp, Artificial sequence
  Synthetic oligonucleotide
gcggccggatacgcgcgggcagggc

SEQ ID NO: 733305 - DNA, 25 bp, Artificial sequence
  Synthetic oligonucleotide
gctgccggtcgccccgacggcgagg

SEQ ID NO: 733306 - DNA, 25 bp, Artificial sequence
  Synthetic oligonucleotide
gctgccggtcgcgccgacggcgagg

SEQ ID NO: 733307 - DNA, 25 bp, Artificial sequence
  Synthetic oligonucleotide
cccgggcgtacgggcccctgctggc

SEQ ID NO: 733308 - DNA, 25 bp, Artificial sequence
  Synthetic oligonucleotide
cccgggcgtacgcgcccctgctggc

SEQ ID NO: 733309 - DNA, 25 bp, Artificial sequence
  Synthetic oligonucleotide
gggctgtagaccgcccgcgggggcg

SEQ ID NO: 733310 - DNA, 25 bp, Artificial sequence
  Synthetic oligonucleotide
gcgcgcccgacgcccgtcgagcgca

SEQ ID NO: 733311 - DNA, 25 bp, Artificial sequence
  Synthetic oligonucleotide
gccccgctacggagacgcggccggc

SEQ ID NO: 733312 - DNA, 25 bp, Artificial sequence
  Synthetic oligonucleotide
gcaggccgcggcgtaacccgcccgc

SEQ ID NO: 733313 - DNA, 25 bp, Artificial sequence
  Synthetic oligonucleotide
gcacccacgcgccgttgcgcccgcc

SEQ ID NO: 733314 - DNA, 25 bp, Artificial sequence
  Synthetic oligonucleotide
gaccgcaccggaggacggcgggcgg

SEQ ID NO: 733315 - DNA, 25 bp, Artificial sequence
  Synthetic oligonucleotide
gaccgcaccggacgacggcgggcgg

SEQ ID NO: 733316 - DNA, 25 bp, Artificial sequence
  Synthetic oligonucleotide
gtggccgggtacccggcgtgggccg

SEQ ID NO: 733317 - DNA, 25 bp, Artificial sequence
  Synthetic oligonucleotide
gtggccgggtacgcggcgtgggccg

SEQ ID NO: 733318 - DNA, 25 bp, Artificial sequence
  Synthetic oligonucleotide
gccgcctctcgagccgacgccgcgc

SEQ ID NO: 733319 - DNA, 25 bp, Artificial sequence
  Synthetic oligonucleotide
gccgcctctcgacccgacgccgcgc

SEQ ID NO: 733320 - DNA, 25 bp, Artificial sequence
  Synthetic oligonucleotide
ccgcgcgcccgaggcgctaccggca

SEQ ID NO: 733321 - DNA, 25 bp, Artificial sequence
  Synthetic oligonucleotide
cgggcccggtcccacgcggcactcg

SEQ ID NO: 733322 - DNA, 25 bp, Artificial sequence
  Synthetic oligonucleotide
gcaggccgcggcctaacccgcccgc

SEQ ID NO: 733323 - DNA, 25 bp, Artificial sequence
  Synthetic oligonucleotide
ccgcgcacgcgagcgttgccgcccc

SEQ ID NO: 733324 - DNA, 25 bp, Artificial sequence
  Synthetic oligonucleotide
gcccgccgcgacggtacggcgacgc

SEQ ID NO: 733325 - DNA, 25 bp, Artificial sequence
  Synthetic oligonucleotide
gcccgccgcgaccgtacggcgacgc

SEQ ID NO: 733326 - DNA, 25 bp, Artificial sequence
  Synthetic oligonucleotide
ggccgggcgtcccagcggtcggtcc

SEQ ID NO: 733327 - DNA, 25 bp, Artificial sequence
  Synthetic oligonucleotide
ggccgggcgtccgagcggtcggtcc

SEQ ID NO: 733328 - DNA, 25 bp, Artificial sequence
  Synthetic oligonucleotide
gaccccgggacgtgcgtcggcccgc

SEQ ID NO: 733329 - DNA, 25 bp, Artificial sequence
  Synthetic oligonucleotide
gaccccgggacgagcgtcggcccgc

SEQ ID NO: 733330 - DNA, 25 bp, Artificial sequence
  Synthetic oligonucleotide
tccgggccgctcggcggtagggcgc

SEQ ID NO: 733331 - DNA, 25 bp, Artificial sequence
  Synthetic oligonucleotide
tccgggccgctccgcggtagggcgc

SEQ ID NO: 733332 - DNA, 25 bp, Artificial sequence
  Synthetic oligonucleotide
ccgccacgcgctcggtcgaggcccg

SEQ ID NO: 733333 - DNA, 25 bp, Artificial sequence
  Synthetic oligonucleotide
ccgcgcgcccgacgcgctaccggca

SEQ ID NO: 733334 - DNA, 25 bp, Artificial sequence
  Synthetic oligonucleotide
ggggcccgcgcggctatgcccccca

SEQ ID NO: 733335 - DNA, 25 bp, Artificial sequence
  Synthetic oligonucleotide
ccgccacgcgctgggtcgaggcccg

SEQ ID NO: 733336 - DNA, 25 bp, Artificial sequence
  Synthetic oligonucleotide
ccgcccgcgtaagcgcgcagcgcgg

SEQ ID NO: 733337 - DNA, 25 bp, Artificial sequence
  Synthetic oligonucleotide
ccgcccgcgtaaccgcgcagcgcgg

SEQ ID NO: 733338 - DNA, 25 bp, Artificial sequence
  Synthetic oligonucleotide
gccccgtaccgccgcgtgtcgggcc

SEQ ID NO: 733339 - DNA, 25 bp, Artificial sequence
  Synthetic oligonucleotide
gccccgtaccgcggcgtgtcgggcc

SEQ ID NO: 733340 - DNA, 25 bp, Artificial sequence
  Synthetic oligonucleotide
gccaccgtcgaccggcgctgggggc

SEQ ID NO: 733341 - DNA, 25 bp, Artificial sequence
  Synthetic oligonucleotide
gccaccgtcgacgggcgctgggggc

SEQ ID NO: 733342 - DNA, 25 bp, Artificial sequence
  Synthetic oligonucleotide
gcccgccgcgcgttcggtcgcggtg

SEQ ID NO: 733343 - DNA, 25 bp, Artificial sequence
  Synthetic oligonucleotide
cgggcccggtccgacgcggcactcg

SEQ ID NO: 733344 - DNA, 25 bp, Artificial sequence
  Synthetic oligonucleotide
ggggcccgcgcgcctatgcccccca

SEQ ID NO: 733345 - DNA, 25 bp, Artificial sequence
  Synthetic oligonucleotide
gcgcgcccgacggccgtcgagcgca

SEQ ID NO: 733346 - DNA, 25 bp, Artificial sequence
  Synthetic oligonucleotide
cgcgggcgtgcgccctacgcagggg

SEQ ID NO: 733347 - DNA, 25 bp, Artificial sequence
  Synthetic oligonucleotide
cgcgggcgtgcggcctacgcagggg

SEQ ID NO: 733348 - DNA, 25 bp, Artificial sequence
  Synthetic oligonucleotide
gcgccgcgcgcgttcggaccccagg

SEQ ID NO: 733349 - DNA, 25 bp, Artificial sequence
  Synthetic oligonucleotide
gcgccgcgcgcgatcggaccccagg

SEQ ID NO: 733350 - DNA, 25 bp, Artificial sequence
  Synthetic oligonucleotide
ccgcgtcgacgccgtagcccgcgcc

SEQ ID NO: 733351 - DNA, 25 bp, Artificial sequence
  Synthetic oligonucleotide
ccgcgtcgacgcggtagcccgcgcc

SEQ ID NO: 733352 - DNA, 25 bp, Artificial sequence
  Synthetic oligonucleotide
ggcagctacgggggcctcgcccccg

SEQ ID NO: 733353 - DNA, 25 bp, Artificial sequence
  Synthetic oligonucleotide
ggcagctacgggcgcctcgcccccg

SEQ ID NO: 733354 - DNA, 25 bp, Artificial sequence
  Synthetic oligonucleotide
ccgcgcacgcgaccgttgccgcccc

SEQ ID NO: 733355 - DNA, 25 bp, Artificial sequence
  Synthetic oligonucleotide
gcccgccgcgcgatcggtcgcggtg

SEQ ID NO: 733356 - DNA, 25 bp, Artificial sequence
  Synthetic oligonucleotide
ccgagctcgcgcaaggccccccgcg

SEQ ID NO: 733357 - DNA, 25 bp, Artificial sequence
  Synthetic oligonucleotide
ggccggcgtcggccgtacggcaggg

SEQ ID NO: 733358 - DNA, 25 bp, Artificial sequence
  Synthetic oligonucleotide
ggccggcgtcgggcgtacggcaggg

SEQ ID NO: 733359 - DNA, 25 bp, Artificial sequence
  Synthetic oligonucleotide
cgccccttgcgcgaccgtccgcggg

SEQ ID NO: 733360 - DNA, 25 bp, Artificial sequence
  Synthetic oligonucleotide
cgccccttgcgccaccgtccgcggg

SEQ ID NO: 733361 - DNA, 25 bp, Artificial sequence
  Synthetic oligonucleotide
ccgcgggttcgtcgcgcggcgtccg

SEQ ID NO: 733362 - DNA, 25 bp, Artificial sequence
  Synthetic oligonucleotide
ccgcgggttcgtggcgcggcgtccg

SEQ ID NO: 733363 - DNA, 25 bp, Artificial sequence
  Synthetic oligonucleotide
cgcacggtcatccgcgcggcccccg

SEQ ID NO: 733364 - DNA, 25 bp, Artificial sequence
  Synthetic oligonucleotide
cgcacggtcatcggcgcggcccccg

SEQ ID NO: 733365 - DNA, 25 bp, Artificial sequence
  Synthetic oligonucleotide
ggcgtggtcgaccgtccgccgcgcg

SEQ ID NO: 733366 - DNA, 25 bp, Artificial sequence
  Synthetic oligonucleotide
cgggcgggtcgtggcgaacggcggc

SEQ ID NO: 733367 - DNA, 25 bp, Artificial sequence
  Synthetic oligonucleotide
ggcagggtcggaccgcggagggccc

SEQ ID NO: 733368 - DNA, 25 bp, Artificial sequence
  Synthetic oligonucleotide
ccgagctcgcgctaggccccccgcg

SEQ ID NO: 733369 - DNA, 25 bp, Artificial sequence
  Synthetic oligonucleotide
gtggcgcggtccgggcgtacgcccc

SEQ ID NO: 733370 - DNA, 25 bp, Artificial sequence
  Synthetic oligonucleotide
gtggcgcggtcccggcgtacgcccc

SEQ ID NO: 733371 - DNA, 25 bp, Artificial sequence
  Synthetic oligonucleotide
cggggcgccgcggctcgtaggccac

SEQ ID NO: 733372 - DNA, 25 bp, Artificial sequence
  Synthetic oligonucleotide
cggggcgccgcgcctcgtaggccac

SEQ ID NO: 733373 - DNA, 25 bp, Artificial sequence
  Synthetic oligonucleotide
gccggcgccctcccgtcgactgccc

SEQ ID NO: 733374 - DNA, 25 bp, Artificial sequence
  Synthetic oligonucleotide
gccggcgccctcgcgtcgactgccc

SEQ ID NO: 733375 - DNA, 25 bp, Artificial sequence
  Synthetic oligonucleotide
ggccccaggccgaacgccgcccgct

SEQ ID NO: 733376 - DNA, 25 bp, Artificial sequence
  Synthetic oligonucleotide
cgggcgggtcgtcgcgaacggcggc

SEQ ID NO: 733377 - DNA, 25 bp, Artificial sequence
  Synthetic oligonucleotide
ggcgtggtcgacggtccgccgcgcg

SEQ ID NO: 733378 - DNA, 25 bp, Artificial sequence
  Synthetic oligonucleotide
cggcgcgtacggcgcgatccggcgg

SEQ ID NO: 733379 - DNA, 25 bp, Artificial sequence
  Synthetic oligonucleotide
cggcgcgtacggggcgatccggcgg

SEQ ID NO: 733380 - DNA, 25 bp, Artificial sequence
  Synthetic oligonucleotide
ggggcgacgcgccggcctacctggc

SEQ ID NO: 733381 - DNA, 25 bp, Artificial sequence
  Synthetic oligonucleotide
ggggcgacgcgcgggcctacctggc

SEQ ID NO: 733382 - DNA, 25 bp, Artificial sequence
  Synthetic oligonucleotide
cgcccccgcgtaccgagggcaggcg

SEQ ID NO: 733383 - DNA, 25 bp, Artificial sequence
  Synthetic oligonucleotide
cgcccccgcgtagcgagggcaggcg

SEQ ID NO: 733384 - DNA, 25 bp, Artificial sequence
  Synthetic oligonucleotide
ccgggcacaaccggtccgccgcgcg

SEQ ID NO: 733385 - DNA, 25 bp, Artificial sequence
  Synthetic oligonucleotide
ccgggcacaacccgtccgccgcgcg

SEQ ID NO: 733386 - DNA, 25 bp, Artificial sequence
  Synthetic oligonucleotide
ggagccagcgcgtccggtgcgcggg

SEQ ID NO: 733387 - DNA, 25 bp, Artificial sequence
  Synthetic oligonucleotide
gcctgggtgtcgaccgcgccccggc

SEQ ID NO: 733388 - DNA, 25 bp, Artificial sequence
  Synthetic oligonucleotide
ggagccagcgcgaccggtgcgcggg

SEQ ID NO: 733389 - DNA, 25 bp, Artificial sequence
  Synthetic oligonucleotide
cgtccgcggccccacgtacggccgc

SEQ ID NO: 733390 - DNA, 25 bp, Artificial sequence
  Synthetic oligonucleotide
gacgggcgcgacggtcgacccggcg

SEQ ID NO: 733391 - DNA, 25 bp, Artificial sequence
  Synthetic oligonucleotide
gacgggcgcgaccgtcgacccggcg

SEQ ID NO: 733392 - DNA, 25 bp, Artificial sequence
  Synthetic oligonucleotide
cgcgggtgcgtacgcagcgggcggg

SEQ ID NO: 733393 - DNA, 25 bp, Artificial sequence
  Synthetic oligonucleotide
cgcgggtgcgtaggcagcgggcggg

SEQ ID NO: 733394 - DNA, 25 bp, Artificial sequence
  Synthetic oligonucleotide
ccggcgaccccgggcgtacgtcgcg

SEQ ID NO: 733395 - DNA, 25 bp, Artificial sequence
  Synthetic oligonucleotide
ccggcgaccccgcgcgtacgtcgcg

SEQ ID NO: 733396 - DNA, 25 bp, Artificial sequence
  Synthetic oligonucleotide
ggcagggtcggagcgcggagggccc

SEQ ID NO: 733397 - DNA, 25 bp, Artificial sequence
  Synthetic oligonucleotide
cgcgtgcggcgtgggatcggcggcg

SEQ ID NO: 733398 - DNA, 25 bp, Artificial sequence
  Synthetic oligonucleotide
gcctgggtgtcgtccgcgccccggc

SEQ ID NO: 733399 - DNA, 25 bp, Artificial sequence
  Synthetic oligonucleotide
ggcccgtcgtcgcgcacccggcgag

SEQ ID NO: 733400 - DNA, 25 bp, Artificial sequence
  Synthetic oligonucleotide
ggccccaggccgtacgccgcccgct

SEQ ID NO: 733401 - DNA, 25 bp, Artificial sequence
  Synthetic oligonucleotide
cccgcctcgttgggcgtcgccgggg

SEQ ID NO: 733402 - DNA, 25 bp, Artificial sequence
  Synthetic oligonucleotide
cccgcctcgttgcgcgtcgccgggg

SEQ ID NO: 733403 - DNA, 25 bp, Artificial sequence
  Synthetic oligonucleotide
ggcgctcgtacgaccgcccggccgg

SEQ ID NO: 733404 - DNA, 25 bp, Artificial sequence
  Synthetic oligonucleotide
ggcgctcgtacgtccgcccggccgg

SEQ ID NO: 733405 - DNA, 25 bp, Artificial sequence
  Synthetic oligonucleotide
ccgccctcgcggcgctgtacgcggg

SEQ ID NO: 733406 - DNA, 25 bp, Artificial sequence
  Synthetic oligonucleotide
ccgccctcgcggggctgtacgcggg

SEQ ID NO: 733407 - DNA, 25 bp, Artificial sequence
  Synthetic oligonucleotide
cgcccgtgcgcgcatcgagggccgc

SEQ ID NO: 733408 - DNA, 25 bp, Artificial sequence
  Synthetic oligonucleotide
gagggcaccgtcccgcctcgggcgg

SEQ ID NO: 733409 - DNA, 25 bp, Artificial sequence
  Synthetic oligonucleotide
ggcccgtcgtcgggcacccggcgag

SEQ ID NO: 733410 - DNA, 25 bp, Artificial sequence
  Synthetic oligonucleotide
ccggcgccgtaggtcgcgacccgcc

SEQ ID NO: 733411 - DNA, 25 bp, Artificial sequence
  Synthetic oligonucleotide
ggtgcgtacgcccccccggcgccac

SEQ ID NO: 733412 - DNA, 25 bp, Artificial sequence
  Synthetic oligonucleotide
ggtgcgtacgccgccccggcgccac

SEQ ID NO: 733413 - DNA, 25 bp, Artificial sequence
  Synthetic oligonucleotide
ctccccggtcccccgtacggcgcgc

SEQ ID NO: 733414 - DNA, 25 bp, Artificial sequence
  Synthetic oligonucleotide
ctccccggtcccgcgtacggcgcgc

SEQ ID NO: 733415 - DNA, 25 bp, Artificial sequence
  Synthetic oligonucleotide
ctggggcggtcccctagcggcccgg

SEQ ID NO: 733416 - DNA, 25 bp, Artificial sequence
  Synthetic oligonucleotide
ctggggcggtccgctagcggcccgg

SEQ ID NO: 733417 - DNA, 25 bp, Artificial sequence
  Synthetic oligonucleotide
ggggcgcgtgcgccgtacgtgggcc

SEQ ID NO: 733418 - DNA, 25 bp, Artificial sequence
  Synthetic oligonucleotide
ggggcgcgtgcggcgtacgtgggcc

SEQ ID NO: 733419 - DNA, 25 bp, Artificial sequence
  Synthetic oligonucleotide
cgcccctaacgtcgccggcgcgcgc

SEQ ID NO: 733420 - DNA, 25 bp, Artificial sequence
  Synthetic oligonucleotide
cgcccgtgcgcggatcgagggccgc

SEQ ID NO: 733421 - DNA, 25 bp, Artificial sequence
  Synthetic oligonucleotide
tggcggtagccgcgcccgagcccgc

SEQ ID NO: 733422 - DNA, 25 bp, Artificial sequence
  Synthetic oligonucleotide
cgcggtgccgggacgacgtggcgcc

SEQ ID NO: 733423 - DNA, 25 bp, Artificial sequence
  Synthetic oligonucleotide
caggggcacgggcgctacgccgccc

SEQ ID NO: 733424 - DNA, 25 bp, Artificial sequence
  Synthetic oligonucleotide
caggggcacgggggctacgccgccc

SEQ ID NO: 733425 - DNA, 25 bp, Artificial sequence
  Synthetic oligonucleotide
gccggctgccgcaacgcggccggga

SEQ ID NO: 733426 - DNA, 25 bp, Artificial sequence
  Synthetic oligonucleotide
gccggctgccgctacgcggccggga

SEQ ID NO: 733427 - DNA, 25 bp, Artificial sequence
  Synthetic oligonucleotide
gggcagcgcgtacgtccgcggcgcc

SEQ ID NO: 733428 - DNA, 25 bp, Artificial sequence
  Synthetic oligonucleotide
gggcagcgcgtaggtccgcggcgcc

SEQ ID NO: 733429 - DNA, 25 bp, Artificial sequence
  Synthetic oligonucleotide
gtggccccgttccgccgagcccggc

SEQ ID NO: 733430 - DNA, 25 bp, Artificial sequence
  Synthetic oligonucleotide
gagggcaccgtcgcgcctcgggcgg

SEQ ID NO: 733431 - DNA, 25 bp, Artificial sequence
  Synthetic oligonucleotide
tggcggtagccgggcccgagcccgc

SEQ ID NO: 733432 - DNA, 25 bp, Artificial sequence
  Synthetic oligonucleotide
cgcgtgcggcgtcggatcggcggcg

SEQ ID NO: 733433 - DNA, 25 bp, Artificial sequence
  Synthetic oligonucleotide
cgggcgatcgtccggcgggcctccg

SEQ ID NO: 733434 - DNA, 25 bp, Artificial sequence
  Synthetic oligonucleotide
cgggcgatcgtcgggcgggcctccg

SEQ ID NO: 733435 - DNA, 25 bp, Artificial sequence
  Synthetic oligonucleotide
ggccaccgcggtccgacgcccccca

SEQ ID NO: 733436 - DNA, 25 bp, Artificial sequence
  Synthetic oligonucleotide
ggccaccgcggtgcgacgcccccca

SEQ ID NO: 733437 - DNA, 25 bp, Artificial sequence
  Synthetic oligonucleotide
cgcggcggttacccggccgccgcca

SEQ ID NO: 733438 - DNA, 25 bp, Artificial sequence
  Synthetic oligonucleotide
cgcggcggttacgcggccgccgcca

SEQ ID NO: 733439 - DNA, 25 bp, Artificial sequence
  Synthetic oligonucleotide
ggcgggcccgtacgctcggcggcga

SEQ ID NO: 733440 - DNA, 25 bp, Artificial sequence
  Synthetic oligonucleotide
ggcgggcccgtaggctcggcggcga

SEQ ID NO: 733441 - DNA, 25 bp, Artificial sequence
  Synthetic oligonucleotide
ccggcgccgtagctcgcgacccgcc

SEQ ID NO: 733442 - DNA, 25 bp, Artificial sequence
  Synthetic oligonucleotide
gtggccccgttcggccgagcccggc

SEQ ID NO: 733443 - DNA, 25 bp, Artificial sequence
  Synthetic oligonucleotide
ggcagcgtcgacccgcggtcggggg

SEQ ID NO: 733444 - DNA, 25 bp, Artificial sequence
  Synthetic oligonucleotide
cgggcccgtcctcgcaacgccgccc

SEQ ID NO: 733445 - DNA, 25 bp, Artificial sequence
  Synthetic oligonucleotide
gccgcccggacgcgtagtggcccgg

SEQ ID NO: 733446 - DNA, 25 bp, Artificial sequence
  Synthetic oligonucleotide
ggtcgccgtacgggcgtcggcgcgc

SEQ ID NO: 733447 - DNA, 25 bp, Artificial sequence
  Synthetic oligonucleotide
ggtcgccgtacgcgcgtcggcgcgc

SEQ ID NO: 733448 - DNA, 25 bp, Artificial sequence
  Synthetic oligonucleotide
ggggaccgttcaggcggggccgcgc

SEQ ID NO: 733449 - DNA, 25 bp, Artificial sequence
  Synthetic oligonucleotide
ggggaccgttcacgcggggccgcgc

SEQ ID NO: 733450 - DNA, 25 bp, Artificial sequence
  Synthetic oligonucleotide
gggccgcatcggctcgccgaggccc

SEQ ID NO: 733451 - DNA, 25 bp, Artificial sequence
  Synthetic oligonucleotide
gggccgcatcgggtcgccgaggccc

SEQ ID NO: 733452 - DNA, 25 bp, Artificial sequence
  Synthetic oligonucleotide
ggccgccgtcgcgcgtatgggcccc

SEQ ID NO: 733453 - DNA, 25 bp, Artificial sequence
  Synthetic oligonucleotide
gcgtgcgtacgtgcgcggccccgcc

SEQ ID NO: 733454 - DNA, 25 bp, Artificial sequence
  Synthetic oligonucleotide
ggccgccgtcgcccgtatgggcccc

SEQ ID NO: 733455 - DNA, 25 bp, Artificial sequence
  Synthetic oligonucleotide
ggcagcgtcgacgcgcggtcggggg

SEQ ID NO: 733456 - DNA, 25 bp, Artificial sequence
  Synthetic oligonucleotide
ccgcgcatcggcggcgagccgcgtc

SEQ ID NO: 733457 - DNA, 25 bp, Artificial sequence
  Synthetic oligonucleotide
ccgcgcatcggccgcgagccgcgtc

SEQ ID NO: 733458 - DNA, 25 bp, Artificial sequence
  Synthetic oligonucleotide
ccggccgtcggtcggcacgccggtc

SEQ ID NO: 733459 - DNA, 25 bp, Artificial sequence
  Synthetic oligonucleotide
ccggccgtcggtgggcacgccggtc

SEQ ID NO: 733460 - DNA, 25 bp, Artificial sequence
  Synthetic oligonucleotide
ccgggcggcgcgaagtcgcccctcc

SEQ ID NO: 733461 - DNA, 25 bp, Artificial sequence
  Synthetic oligonucleotide
ccgggcggcgcgtagtcgcccctcc

SEQ ID NO: 733462 - DNA, 25 bp, Artificial sequence
  Synthetic oligonucleotide
gccgtgtcgaaccggccgcggggcc

SEQ ID NO: 733463 - DNA, 25 bp, Artificial sequence
  Synthetic oligonucleotide
ggcggccgcgcccgatcgtcctggc

SEQ ID NO: 733464 - DNA, 25 bp, Artificial sequence
  Synthetic oligonucleotide
gcgtgcgtacgtccgcggccccgcc

SEQ ID NO: 733465 - DNA, 25 bp, Artificial sequence
  Synthetic oligonucleotide
ccgcggcgggcgcgacgtaccccac

SEQ ID NO: 733466 - DNA, 25 bp, Artificial sequence
  Synthetic oligonucleotide
ggcccggtcgcgggatcgggcgagg

SEQ ID NO: 733467 - DNA, 25 bp, Artificial sequence
  Synthetic oligonucleotide
ggcccggtcgcgcgatcgggcgagg

SEQ ID NO: 733468 - DNA, 25 bp, Artificial sequence
  Synthetic oligonucleotide
ggcggcgccccgtagtcgaccggcc

SEQ ID NO: 733469 - DNA, 25 bp, Artificial sequence
  Synthetic oligonucleotide
ggcggcgccccgaagtcgaccggcc

SEQ ID NO: 733470 - DNA, 25 bp, Artificial sequence
  Synthetic oligonucleotide
gcggcgccgtcgtacgcggggggct

SEQ ID NO: 733471 - DNA, 25 bp, Artificial sequence
  Synthetic oligonucleotide
gcggcgccgtcgaacgcggggggct

SEQ ID NO: 733472 - DNA, 25 bp, Artificial sequence
  Synthetic oligonucleotide
cgcggccgcgtccgcacgagcgcac

SEQ ID NO: 733473 - DNA, 25 bp, Artificial sequence
  Synthetic oligonucleotide
cgcggccgcgtcggcacgagcgcac

SEQ ID NO: 733474 - DNA, 25 bp, Artificial sequence
  Synthetic oligonucleotide
gccgcccggacgggtagtggcccgg

SEQ ID NO: 733475 - DNA, 25 bp, Artificial sequence
  Synthetic oligonucleotide
ccccgctagcgccccgacggtccgc

SEQ ID NO: 733476 - DNA, 25 bp, Artificial sequence
  Synthetic oligonucleotide
cgggcccgtcctggcaacgccgccc

SEQ ID NO: 733477 - DNA, 25 bp, Artificial sequence
  Synthetic oligonucleotide
ccgcggcgggcgggacgtaccccac

SEQ ID NO: 733478 - DNA, 25 bp, Artificial sequence
  Synthetic oligonucleotide
ggccggcagactcgcgcgtgccggg

SEQ ID NO: 733479 - DNA, 25 bp, Artificial sequence
  Synthetic oligonucleotide
ggccggcagactggcgcgtgccggg

SEQ ID NO: 733480 - DNA, 25 bp, Artificial sequence
  Synthetic oligonucleotide
ggcgccggtgcatcgcgcacggccg

SEQ ID NO: 733481 - DNA, 25 bp, Artificial sequence
  Synthetic oligonucleotide
ggcgccggtgcaacgcgcacggccg

SEQ ID NO: 733482 - DNA, 25 bp, Artificial sequence
  Synthetic oligonucleotide
ggccgctcggtaggggcgcaggccc

SEQ ID NO: 733483 - DNA, 25 bp, Artificial sequence
  Synthetic oligonucleotide
ggccgctcggtacgggcgcaggccc

SEQ ID NO: 733484 - DNA, 25 bp, Artificial sequence
  Synthetic oligonucleotide
cccccggcgccgctacggaggctgc

SEQ ID NO: 733485 - DNA, 25 bp, Artificial sequence
  Synthetic oligonucleotide
cccccggcgccggtacggaggctgc

SEQ ID NO: 733486 - DNA, 25 bp, Artificial sequence
  Synthetic oligonucleotide
ccccgctagcgcgccgacggtccgc

SEQ ID NO: 733487 - DNA, 25 bp, Artificial sequence
  Synthetic oligonucleotide
ggcgggtacgcgtgggcggcccgct

SEQ ID NO: 733488 - DNA, 25 bp, Artificial sequence
  Synthetic oligonucleotide
gccgtgtcgaacgggccgcggggcc

SEQ ID NO: 733489 - DNA, 25 bp, Artificial sequence
  Synthetic oligonucleotide
ccggtcacgacgggtgcggggcccc

SEQ ID NO: 733490 - DNA, 25 bp, Artificial sequence
  Synthetic oligonucleotide
ggcgggcggtaccaccgcgcggagc

SEQ ID NO: 733491 - DNA, 25 bp, Artificial sequence
  Synthetic oligonucleotide
ggcgggcggtacgaccgcgcggagc

SEQ ID NO: 733492 - DNA, 25 bp, Artificial sequence
  Synthetic oligonucleotide
tccgccgggcggtcgtacggcggcc

SEQ ID NO: 733493 - DNA, 25 bp, Artificial sequence
  Synthetic oligonucleotide
tccgccgggcggacgtacggcggcc

SEQ ID NO: 733494 - DNA, 25 bp, Artificial sequence
  Synthetic oligonucleotide
cacgcctcgctagcgcgccgggcgc

SEQ ID NO: 733495 - DNA, 25 bp, Artificial sequence
  Synthetic oligonucleotide
cacgcctcgctaccgcgccgggcgc

SEQ ID NO: 733496 - DNA, 25 bp, Artificial sequence
  Synthetic oligonucleotide
ggctgcgccgcgacgtacgcccgcc

SEQ ID NO: 733497 - DNA, 25 bp, Artificial sequence
  Synthetic oligonucleotide
gcggcgcgaccggctcgaacggccg

SEQ ID NO: 733498 - DNA, 25 bp, Artificial sequence
  Synthetic oligonucleotide
ggctgcgccgcgtcgtacgcccgcc

SEQ ID NO: 733499 - DNA, 25 bp, Artificial sequence
  Synthetic oligonucleotide
ggcgggtacgcgagggcggcccgct

SEQ ID NO: 733500 - DNA, 25 bp, Artificial sequence
  Synthetic oligonucleotide
ggcggcgacggcctacgctggggcg

SEQ ID NO: 733501 - DNA, 25 bp, Artificial sequence
  Synthetic oligonucleotide
ggcggcgacggcgtacgctggggcg

SEQ ID NO: 733502 - DNA, 25 bp, Artificial sequence
  Synthetic oligonucleotide
ggcggcctacgtcggtccgcgcccg

SEQ ID NO: 733503 - DNA, 25 bp, Artificial sequence
  Synthetic oligonucleotide
ggcggcctacgtgggtccgcgcccg

SEQ ID NO: 733504 - DNA, 25 bp, Artificial sequence
  Synthetic oligonucleotide
ccccgcggtagcctccacgggccgc

SEQ ID NO: 733505 - DNA, 25 bp, Artificial sequence
  Synthetic oligonucleotide
ccccgcggtagcgtccacgggccgc

SEQ ID NO: 733506 - DNA, 25 bp, Artificial sequence
  Synthetic oligonucleotide
cgcggtgccgggtcgacgtggcgcc

SEQ ID NO: 733507 - DNA, 25 bp, Artificial sequence
  Synthetic oligonucleotide
ccccgcggcgtagcccgatgcggcg

SEQ ID NO: 733508 - DNA, 25 bp, Artificial sequence
  Synthetic oligonucleotide
gcggcgcgaccgcctcgaacggccg

SEQ ID NO: 733509 - DNA, 25 bp, Artificial sequence
  Synthetic oligonucleotide
ccccgccggacggccgtatcggcgc

SEQ ID NO: 733510 - DNA, 25 bp, Artificial sequence
  Synthetic oligonucleotide
gcgcccccgtgttgcgcaccccccc

SEQ ID NO: 733511 - DNA, 25 bp, Artificial sequence
  Synthetic oligonucleotide
gcgcccccgtgtagcgcaccccccc

SEQ ID NO: 733512 - DNA, 25 bp, Artificial sequence
  Synthetic oligonucleotide
cgcgcgggtgcgccccgtaccgacc

SEQ ID NO: 733513 - DNA, 25 bp, Artificial sequence
  Synthetic oligonucleotide
cgcgcgggtgcggcccgtaccgacc

SEQ ID NO: 733514 - DNA, 25 bp, Artificial sequence
  Synthetic oligonucleotide
gccgcggtaccgtcgagcgccggcc

SEQ ID NO: 733515 - DNA, 25 bp, Artificial sequence
  Synthetic oligonucleotide
gccgcggtaccgacgagcgccggcc

SEQ ID NO: 733516 - DNA, 25 bp, Artificial sequence
  Synthetic oligonucleotide
gcgcgggcgcgtgtcgagggctcgg

SEQ ID NO: 733517 - DNA, 25 bp, Artificial sequence
  Synthetic oligonucleotide
gcgcgggcgcgtctcgagggctcgg

SEQ ID NO: 733518 - DNA, 25 bp, Artificial sequence
  Synthetic oligonucleotide
ccggtcacgacgcgtgcggggcccc

SEQ ID NO: 733519 - DNA, 25 bp, Artificial sequence
  Synthetic oligonucleotide
gggccggcgccgggtacatggccgg

SEQ ID NO: 733520 - DNA, 25 bp, Artificial sequence
  Synthetic oligonucleotide
ggcggccgcgccggatcgtcctggc

SEQ ID NO: 733521 - DNA, 25 bp, Artificial sequence
  Synthetic oligonucleotide
ccccgccggacgcccgtatcggcgc

SEQ ID NO: 733522 - DNA, 25 bp, Artificial sequence
  Synthetic oligonucleotide
cggcctctcgacccgggggtgcccc

SEQ ID NO: 733523 - DNA, 25 bp, Artificial sequence
  Synthetic oligonucleotide
cggcctctcgacgcgggggtgcccc

SEQ ID NO: 733524 - DNA, 25 bp, Artificial sequence
  Synthetic oligonucleotide
ccgcgcgccgtagcgcggtgcagcc

SEQ ID NO: 733525 - DNA, 25 bp, Artificial sequence
  Synthetic oligonucleotide
ccgcgcgccgtaccgcggtgcagcc

SEQ ID NO: 733526 - DNA, 25 bp, Artificial sequence
  Synthetic oligonucleotide
tggccggggccgatcgacgcccggc

SEQ ID NO: 733527 - DNA, 25 bp, Artificial sequence
  Synthetic oligonucleotide
tggccggggccgttcgacgcccggc

SEQ ID NO: 733528 - DNA, 25 bp, Artificial sequence
  Synthetic oligonucleotide
cgccggtggtacggcgacggcgcgc

SEQ ID NO: 733529 - DNA, 25 bp, Artificial sequence
  Synthetic oligonucleotide
cgccggtggtaccgcgacggcgcgc

SEQ ID NO: 733530 - DNA, 25 bp, Artificial sequence
  Synthetic oligonucleotide
gggccggcgccgcgtacatggccgg

SEQ ID NO: 733531 - DNA, 25 bp, Artificial sequence
  Synthetic oligonucleotide
ggccgagccaacgcgcggtggggcg

SEQ ID NO: 733532 - DNA, 25 bp, Artificial sequence
  Synthetic oligonucleotide
cgcccctaacgtggccggcgcgcgc

SEQ ID NO: 733533 - DNA, 25 bp, Artificial sequence
  Synthetic oligonucleotide
ccccggcccgcgctacgacgcagcg

SEQ ID NO: 733534 - DNA, 25 bp, Artificial sequence
  Synthetic oligonucleotide
tgcccccggtcccagcgacgcccgg

SEQ ID NO: 733535 - DNA, 25 bp, Artificial sequence
  Synthetic oligonucleotide
cgcgcgcgtgcgacgcaccccggac

SEQ ID NO: 733536 - DNA, 25 bp, Artificial sequence
  Synthetic oligonucleotide
cgcgcgcgtgcgtcgcaccccggac

SEQ ID NO: 733537 - DNA, 25 bp, Artificial sequence
  Synthetic oligonucleotide
ggccgccggcgcccgtagtaggcgc

SEQ ID NO: 733538 - DNA, 25 bp, Artificial sequence
  Synthetic oligonucleotide
ggccgccggcgcgcgtagtaggcgc

SEQ ID NO: 733539 - DNA, 25 bp, Artificial sequence
  Synthetic oligonucleotide
gcggcgtacggcgcgcgcacggacg

SEQ ID NO: 733540 - DNA, 25 bp, Artificial sequence
  Synthetic oligonucleotide
gcggcgtacggcccgcgcacggacg

SEQ ID NO: 733541 - DNA, 25 bp, Artificial sequence
  Synthetic oligonucleotide
ggcgcgcgtcgaaacccgcgggccc

SEQ ID NO: 733542 - DNA, 25 bp, Artificial sequence
  Synthetic oligonucleotide
ggcgcgcgtcgatacccgcgggccc

SEQ ID NO: 733543 - DNA, 25 bp, Artificial sequence
  Synthetic oligonucleotide
ggggggagctcgggtagcgccggcc

SEQ ID NO: 733544 - DNA, 25 bp, Artificial sequence
  Synthetic oligonucleotide
gccgcctacgtccaccgcgggcccg

SEQ ID NO: 733545 - DNA, 25 bp, Artificial sequence
  Synthetic oligonucleotide
agggcgcgatacgcggccgccgcgc

SEQ ID NO: 733546 - DNA, 25 bp, Artificial sequence
  Synthetic oligonucleotide
ccccggcccgcggtacgacgcagcg

SEQ ID NO: 733547 - DNA, 25 bp, Artificial sequence
  Synthetic oligonucleotide
cctgccacgcgcggtagcggggccc

SEQ ID NO: 733548 - DNA, 25 bp, Artificial sequence
  Synthetic oligonucleotide
cctgccacgcgccgtagcggggccc

SEQ ID NO: 733549 - DNA, 25 bp, Artificial sequence
  Synthetic oligonucleotide
acgggcgcacgcgacgaccccgccg

SEQ ID NO: 733550 - DNA, 25 bp, Artificial sequence
  Synthetic oligonucleotide
acgggcgcacgccacgaccccgccg

SEQ ID NO: 733551 - DNA, 25 bp, Artificial sequence
  Synthetic oligonucleotide
gacccgccgcgcctacgtgcccggg

SEQ ID NO: 733552 - DNA, 25 bp, Artificial sequence
  Synthetic oligonucleotide
gacccgccgcgcgtacgtgcccggg

SEQ ID NO: 733553 - DNA, 25 bp, Artificial sequence
  Synthetic oligonucleotide
cccgcgcgtccgctacgaggcggcc

SEQ ID NO: 733554 - DNA, 25 bp, Artificial sequence
  Synthetic oligonucleotide
cccgcgcgtccggtacgaggcggcc

SEQ ID NO: 733555 - DNA, 25 bp, Artificial sequence
  Synthetic oligonucleotide
tgcccccggtccgagcgacgcccgg

SEQ ID NO: 733556 - DNA, 25 bp, Artificial sequence
  Synthetic oligonucleotide
gccgcctacgtcgaccgcgggcccg

SEQ ID NO: 733557 - DNA, 25 bp, Artificial sequence
  Synthetic oligonucleotide
ggcccgtagacgcccggcgcctccg

SEQ ID NO: 733558 - DNA, 25 bp, Artificial sequence
  Synthetic oligonucleotide
cggctcccgcgccgacgtacgcgcg

SEQ ID NO: 733559 - DNA, 25 bp, Artificial sequence
  Synthetic oligonucleotide
cggctcccgcgcggacgtacgcgcg

SEQ ID NO: 733560 - DNA, 25 bp, Artificial sequence
  Synthetic oligonucleotide
cggggggtacgcctccgcgtggcgc

SEQ ID NO: 733561 - DNA, 25 bp, Artificial sequence
  Synthetic oligonucleotide
cggggggtacgcgtccgcgtggcgc

SEQ ID NO: 733562 - DNA, 25 bp, Artificial sequence
  Synthetic oligonucleotide
ggcgggggccgtacgagcgccacgg

SEQ ID NO: 733563 - DNA, 25 bp, Artificial sequence
  Synthetic oligonucleotide
ggcgggggccgttcgagcgccacgg

SEQ ID NO: 733564 - DNA, 25 bp, Artificial sequence
  Synthetic oligonucleotide
gcggcggttccggggcgtacggccc

SEQ ID NO: 733565 - DNA, 25 bp, Artificial sequence
  Synthetic oligonucleotide
gcggcggttccgcggcgtacggccc

SEQ ID NO: 733566 - DNA, 25 bp, Artificial sequence
  Synthetic oligonucleotide
gccgggcgaccgcgcgtctacgcgg

SEQ ID NO: 733567 - DNA, 25 bp, Artificial sequence
  Synthetic oligonucleotide
agggcgcgatacccggccgccgcgc

SEQ ID NO: 733568 - DNA, 25 bp, Artificial sequence
  Synthetic oligonucleotide
ggcccgtagacggccggcgcctccg

SEQ ID NO: 733569 - DNA, 25 bp, Artificial sequence
  Synthetic oligonucleotide
ggccgagccaacccgcggtggggcg

SEQ ID NO: 733570 - DNA, 25 bp, Artificial sequence
  Synthetic oligonucleotide
cggcgcgcgcaaggcccgtgcgggt

SEQ ID NO: 733571 - DNA, 25 bp, Artificial sequence
  Synthetic oligonucleotide
cggcgcgcgcaacgcccgtgcgggt

SEQ ID NO: 733572 - DNA, 25 bp, Artificial sequence
  Synthetic oligonucleotide
gccgcccgtcgcctgagcgcgcctc

SEQ ID NO: 733573 - DNA, 25 bp, Artificial sequence
  Synthetic oligonucleotide
gccgcccgtcgcgtgagcgcgcctc

SEQ ID NO: 733574 - DNA, 25 bp, Artificial sequence
  Synthetic oligonucleotide
cgcgggcgtagcgcggtacgccgcc

SEQ ID NO: 733575 - DNA, 25 bp, Artificial sequence
  Synthetic oligonucleotide
cgcgggcgtagcccggtacgccgcc

SEQ ID NO: 733576 - DNA, 25 bp, Artificial sequence
  Synthetic oligonucleotide
gcgaggcgcgcgtagcgacggcgcg

SEQ ID NO: 733577 - DNA, 25 bp, Artificial sequence
  Synthetic oligonucleotide
gcgaggcgcgcgaagcgacggcgcg

SEQ ID NO: 733578 - DNA, 25 bp, Artificial sequence
  Synthetic oligonucleotide
gccagcccgtacgacggcccgggcg

SEQ ID NO: 733579 - DNA, 25 bp, Artificial sequence
  Synthetic oligonucleotide
gccagcccgtaccacggcccgggcg

SEQ ID NO: 733580 - DNA, 25 bp, Artificial sequence
  Synthetic oligonucleotide
gccgggcgaccgggcgtctacgcgg

SEQ ID NO: 733581 - DNA, 25 bp, Artificial sequence
  Synthetic oligonucleotide
ggggggagctcgcgtagcgccggcc

SEQ ID NO: 733582 - DNA, 25 bp, Artificial sequence
  Synthetic oligonucleotide
ccggaggcggtgccgtggcggccgg

SEQ ID NO: 733583 - DNA, 25 bp, Artificial sequence
  Synthetic oligonucleotide
cgcagcgcgcgcgccggtagccggc

SEQ ID NO: 733584 - DNA, 25 bp, Artificial sequence
  Synthetic oligonucleotide
cgcagcgcgcgccccggtagccggc

SEQ ID NO: 733585 - DNA, 25 bp, Artificial sequence
  Synthetic oligonucleotide
ccgctctcggcacggcgccgccggg

SEQ ID NO: 733586 - DNA, 25 bp, Artificial sequence
  Synthetic oligonucleotide
ccgctctcggcagggcgccgccggg

SEQ ID NO: 733587 - DNA, 25 bp, Artificial sequence
  Synthetic oligonucleotide
cggccccggacgcgcgacgcgaccc

SEQ ID NO: 733588 - DNA, 25 bp, Artificial sequence
  Synthetic oligonucleotide
cctgggccgcccgcgctaccggcgg

SEQ ID NO: 733589 - DNA, 25 bp, Artificial sequence
  Synthetic oligonucleotide
ccggaggcggtggcgtggcggccgg

SEQ ID NO: 733590 - DNA, 25 bp, Artificial sequence
  Synthetic oligonucleotide
cctccgcgccgggccgacgcgcgca

SEQ ID NO: 733591 - DNA, 25 bp, Artificial sequence
  Synthetic oligonucleotide
cgcggccgtcgctgtgcgcgggggc

SEQ ID NO: 733592 - DNA, 25 bp, Artificial sequence
  Synthetic oligonucleotide
cgcggccgtcgcagtgcgcgggggc

SEQ ID NO: 733593 - DNA, 25 bp, Artificial sequence
  Synthetic oligonucleotide
ggcgcggaccggtccccccacgcgc

SEQ ID NO: 733594 - DNA, 25 bp, Artificial sequence
  Synthetic oligonucleotide
ggcgcggaccggaccccccacgcgc

SEQ ID NO: 733595 - DNA, 25 bp, Artificial sequence
  Synthetic oligonucleotide
ggtgcgctaccggcccgcgccgccc

SEQ ID NO: 733596 - DNA, 25 bp, Artificial sequence
  Synthetic oligonucleotide
cggccccggacgggcgacgcgaccc

SEQ ID NO: 733597 - DNA, 25 bp, Artificial sequence
  Synthetic oligonucleotide
gccggccgacgaggcgcggcctgcc

SEQ ID NO: 733598 - DNA, 25 bp, Artificial sequence
  Synthetic oligonucleotide
ccctggtgccggctcgccgccccgg

SEQ ID NO: 733599 - DNA, 25 bp, Artificial sequence
  Synthetic oligonucleotide
ccctggtgccgggtcgccgccccgg

SEQ ID NO: 733600 - DNA, 25 bp, Artificial sequence
  Synthetic oligonucleotide
cggcccgcgccgtgtcgtccccggc

SEQ ID NO: 733601 - DNA, 25 bp, Artificial sequence
  Synthetic oligonucleotide
cggcccgcgccgagtcgtccccggc

SEQ ID NO: 733602 - DNA, 25 bp, Artificial sequence
  Synthetic oligonucleotide
gtgccgcgcccgcgggggcagctcc

SEQ ID NO: 733603 - DNA, 25 bp, Artificial sequence
  Synthetic oligonucleotide
gccctggcgccggctcgacccgccg

SEQ ID NO: 733604 - DNA, 25 bp, Artificial sequence
  Synthetic oligonucleotide
gccggccgacgacgcgcggcctgcc

SEQ ID NO: 733605 - DNA, 25 bp, Artificial sequence
  Synthetic oligonucleotide
gccctggcgccgcctcgacccgccg

SEQ ID NO: 733606 - DNA, 25 bp, Artificial sequence
  Synthetic oligonucleotide
cgctcgggcccggcggtcgccagcg

SEQ ID NO: 733607 - DNA, 25 bp, Artificial sequence
  Synthetic oligonucleotide
cgctcgggcccgccggtcgccagcg

SEQ ID NO: 733608 - DNA, 25 bp, Artificial sequence
  Synthetic oligonucleotide
ggcgccccgggcgcgacgacctgcc

SEQ ID NO: 733609 - DNA, 25 bp, Artificial sequence
  Synthetic oligonucleotide
ggcgccccgggcccgacgacctgcc

SEQ ID NO: 733610 - DNA, 25 bp, Artificial sequence
  Synthetic oligonucleotide
cctccgcgccggcccgacgcgcgca

SEQ ID NO: 733611 - DNA, 25 bp, Artificial sequence
  Synthetic oligonucleotide
cgtgcggcggccgtcggcccgctcg

SEQ ID NO: 733612 - DNA, 25 bp, Artificial sequence
  Synthetic oligonucleotide
gtgccgcgcccgggggggcagctcc

SEQ ID NO: 733613 - DNA, 25 bp, Artificial sequence
  Synthetic oligonucleotide
gcggcccggacgcgccttcccgcgc

SEQ ID NO: 733614 - DNA, 25 bp, Artificial sequence
  Synthetic oligonucleotide
gggccccgggggccgatcccgcagc

SEQ ID NO: 733615 - DNA, 25 bp, Artificial sequence
  Synthetic oligonucleotide
gggccccggggggcgatcccgcagc

SEQ ID NO: 733616 - DNA, 25 bp, Artificial sequence
  Synthetic oligonucleotide
gcctacgcggccgtcggccggcgcc

SEQ ID NO: 733617 - DNA, 25 bp, Artificial sequence
  Synthetic oligonucleotide
gcctacgcggccctcggccggcgcc

SEQ ID NO: 733618 - DNA, 25 bp, Artificial sequence
  Synthetic oligonucleotide
gcccggcaggtcacgcgcggcgcgc

SEQ ID NO: 733619 - DNA, 25 bp, Artificial sequence
  Synthetic oligonucleotide
ggtgcgctaccgccccgcgccgccc

SEQ ID NO: 733620 - DNA, 25 bp, Artificial sequence
  Synthetic oligonucleotide
gcggcccggacgggccttcccgcgc

SEQ ID NO: 733621 - DNA, 25 bp, Artificial sequence
  Synthetic oligonucleotide
tggcctgccggcgcgccgcgcccag

SEQ ID NO: 733622 - DNA, 25 bp, Artificial sequence
  Synthetic oligonucleotide
accgcggcgggccacgccgtggccc

SEQ ID NO: 733623 - DNA, 25 bp, Artificial sequence
  Synthetic oligonucleotide
accgcggcgggcgacgccgtggccc

SEQ ID NO: 733624 - DNA, 25 bp, Artificial sequence
  Synthetic oligonucleotide
ggaccgccggacgcgccggcgacgg

SEQ ID NO: 733625 - DNA, 25 bp, Artificial sequence
  Synthetic oligonucleotide
ggaccgccggacccgccggcgacgg

SEQ ID NO: 733626 - DNA, 25 bp, Artificial sequence
  Synthetic oligonucleotide
ggggcccggcgtgcccgcggagcga

SEQ ID NO: 733627 - DNA, 25 bp, Artificial sequence
  Synthetic oligonucleotide
ggggcccggcgtccccgcggagcga

SEQ ID NO: 733628 - DNA, 25 bp, Artificial sequence
  Synthetic oligonucleotide
gcccggcaggtctcgcgcggcgcgc

SEQ ID NO: 733629 - DNA, 25 bp, Artificial sequence
  Synthetic oligonucleotide
cgcgcccggcgcggcgtgccgcatg

SEQ ID NO: 733630 - DNA, 25 bp, Artificial sequence
  Synthetic oligonucleotide
gcggcgcgcgtgccgtacccgcggc

SEQ ID NO: 733631 - DNA, 25 bp, Artificial sequence
  Synthetic oligonucleotide
cggacccgcgcggcagggcgtgcgg

SEQ ID NO: 733632 - DNA, 25 bp, Artificial sequence
  Synthetic oligonucleotide
cggacccgcgcgccagggcgtgcgg

SEQ ID NO: 733633 - DNA, 25 bp, Artificial sequence
  Synthetic oligonucleotide
cccaccccccgcctgcggctgcccc

SEQ ID NO: 733634 - DNA, 25 bp, Artificial sequence
  Synthetic oligonucleotide
cccaccccccgcgtgcggctgcccc

SEQ ID NO: 733635 - DNA, 25 bp, Artificial sequence
  Synthetic oligonucleotide
gcgcggcgggccctctggcgcggtc

SEQ ID NO: 733636 - DNA, 25 bp, Artificial sequence
  Synthetic oligonucleotide
cggccacgtctgcccggcgggcgcc

SEQ ID NO: 733637 - DNA, 25 bp, Artificial sequence
  Synthetic oligonucleotide
cgcgcccggcgccgcgtgccgcatg

SEQ ID NO: 733638 - DNA, 25 bp, Artificial sequence
  Synthetic oligonucleotide
gggcgccgcgcacgggcccgtcgga

SEQ ID NO: 733639 - DNA, 25 bp, Artificial sequence
  Synthetic oligonucleotide
cggtcgtcggagcgcccccgcgcgg

SEQ ID NO: 733640 - DNA, 25 bp, Artificial sequence
  Synthetic oligonucleotide
cggtcgtcggagggcccccgcgcgg

SEQ ID NO: 733641 - DNA, 25 bp, Artificial sequence
  Synthetic oligonucleotide
ccgtgcgcgtcgcggccgccgtgcg

SEQ ID NO: 733642 - DNA, 25 bp, Artificial sequence
  Synthetic oligonucleotide
ccgtgcgcgtcggggccgccgtgcg

SEQ ID NO: 733643 - DNA, 25 bp, Artificial sequence
  Synthetic oligonucleotide
gggcgccgcgcaggggcccgtcgga

SEQ ID NO: 733644 - DNA, 25 bp, Artificial sequence
  Synthetic oligonucleotide
cgtgcggcggccctcggcccgctcg

SEQ ID NO: 733645 - DNA, 25 bp, Artificial sequence
  Synthetic oligonucleotide
gcgcggcgggccgtctggcgcggtc

SEQ ID NO: 733646 - DNA, 25 bp, Artificial sequence
  Synthetic oligonucleotide
ggcgccgagaggccccccgtggccg

SEQ ID NO: 733647 - DNA, 25 bp, Artificial sequence
  Synthetic oligonucleotide
cctgggccgcccccgctaccggcgg

SEQ ID NO: 733648 - DNA, 25 bp, Artificial sequence
  Synthetic oligonucleotide
ggcggcgcgccgaccgaccgcctcc

SEQ ID NO: 733649 - DNA, 25 bp, Artificial sequence
  Synthetic oligonucleotide
cccgtgcggccgagcccggggcgca

SEQ ID NO: 733650 - DNA, 25 bp, Artificial sequence
  Synthetic oligonucleotide
cccgtgcggccgtgcccggggcgca

SEQ ID NO: 733651 - DNA, 25 bp, Artificial sequence
  Synthetic oligonucleotide
ccggcgccggcagcgtgcgccgctc

SEQ ID NO: 733652 - DNA, 25 bp, Artificial sequence
  Synthetic oligonucleotide
tgcgccccgggccggacggcctgcc

SEQ ID NO: 733653 - DNA, 25 bp, Artificial sequence
  Synthetic oligonucleotide
ggcgccgagagggcccccgtggccg

SEQ ID NO: 733654 - DNA, 25 bp, Artificial sequence
  Synthetic oligonucleotide
cgcgcggccgcgcacgccgtgggtg

SEQ ID NO: 733655 - DNA, 25 bp, Artificial sequence
  Synthetic oligonucleotide
ccgccggtcgcccgcggcgagtggc

SEQ ID NO: 733656 - DNA, 25 bp, Artificial sequence
  Synthetic oligonucleotide
ccgccggtcgccggcggcgagtggc

SEQ ID NO: 733657 - DNA, 25 bp, Artificial sequence
  Synthetic oligonucleotide
aaggggtgccgccccgcggcgccgg

SEQ ID NO: 733658 - DNA, 25 bp, Artificial sequence
  Synthetic oligonucleotide
aaggggtgccgcgccgcggcgccgg

SEQ ID NO: 733659 - DNA, 25 bp, Artificial sequence
  Synthetic oligonucleotide
cggcggcgacgctgccgcggcccca

SEQ ID NO: 733660 - DNA, 25 bp, Artificial sequence
  Synthetic oligonucleotide
cggcggcgacgcagccgcggcccca

SEQ ID NO: 733661 - DNA, 25 bp, Artificial sequence
  Synthetic oligonucleotide
ccggcgccggcaccgtgcgccgctc

SEQ ID NO: 733662 - DNA, 25 bp, Artificial sequence
  Synthetic oligonucleotide
gggcgcggcaacaggcgcgcgcggg

SEQ ID NO: 733663 - DNA, 25 bp, Artificial sequence
  Synthetic oligonucleotide
cggcaggcgccggccaacccgccgg

SEQ ID NO: 733664 - DNA, 25 bp, Artificial sequence
  Synthetic oligonucleotide
gcggcgccggcgcgtaccgaggggg

SEQ ID NO: 733665 - DNA, 25 bp, Artificial sequence
  Synthetic oligonucleotide
gcggcgccggcgggtaccgaggggg

SEQ ID NO: 733666 - DNA, 25 bp, Artificial sequence
  Synthetic oligonucleotide
cccccggtgcgcgagcggcgggtcc

SEQ ID NO: 733667 - DNA, 25 bp, Artificial sequence
  Synthetic oligonucleotide
cccccggtgcgccagcggcgggtcc

SEQ ID NO: 733668 - DNA, 25 bp, Artificial sequence
  Synthetic oligonucleotide
ggcggcgcgccgtccgaccgcctcc

SEQ ID NO: 733669 - DNA, 25 bp, Artificial sequence
  Synthetic oligonucleotide
cggtgcccggcgcccgaccgggtgc

SEQ ID NO: 733670 - DNA, 25 bp, Artificial sequence
  Synthetic oligonucleotide
cgcccgcgcgtcccgcctccggctg

SEQ ID NO: 733671 - DNA, 25 bp, Artificial sequence
  Synthetic oligonucleotide
gggcgcggcaactggcgcgcgcggg

SEQ ID NO: 733672 - DNA, 25 bp, Artificial sequence
  Synthetic oligonucleotide
cccggcggctgggcgccaccgcgag

SEQ ID NO: 733673 - DNA, 25 bp, Artificial sequence
  Synthetic oligonucleotide
cccggcggctggccgccaccgcgag

SEQ ID NO: 733674 - DNA, 25 bp, Artificial sequence
  Synthetic oligonucleotide
cgccccgcctcgcagccgcgctgcg

SEQ ID NO: 733675 - DNA, 25 bp, Artificial sequence
  Synthetic oligonucleotide
cgccccgcctcggagccgcgctgcg

SEQ ID NO: 733676 - DNA, 25 bp, Artificial sequence
  Synthetic oligonucleotide
cgcgcggccgcggacgccgtgggtg

SEQ ID NO: 733677 - DNA, 25 bp, Artificial sequence
  Synthetic oligonucleotide
cggtgcccggcggccgaccgggtgc

SEQ ID NO: 733678 - DNA, 25 bp, Artificial sequence
  Synthetic oligonucleotide
gcctggcgctaccgcccccgcgggc

SEQ ID NO: 733679 - DNA, 25 bp, Artificial sequence
  Synthetic oligonucleotide
gtccaccgccgtccggcgggccccc

SEQ ID NO: 733680 - DNA, 25 bp, Artificial sequence
  Synthetic oligonucleotide
gtccaccgccgtgcggcgggccccc

SEQ ID NO: 733681 - DNA, 25 bp, Artificial sequence
  Synthetic oligonucleotide
cggaggccgcgcggcgcgtggccct

SEQ ID NO: 733682 - DNA, 25 bp, Artificial sequence
  Synthetic oligonucleotide
cggaggccgcgccgcgcgtggccct

SEQ ID NO: 733683 - DNA, 25 bp, Artificial sequence
  Synthetic oligonucleotide
gccacgccccgtcgccgagcggggg

SEQ ID NO: 733684 - DNA, 25 bp, Artificial sequence
  Synthetic oligonucleotide
ggacccgtcgcgccggcccgtgcgg

SEQ ID NO: 733685 - DNA, 25 bp, Artificial sequence
  Synthetic oligonucleotide
gcctggcgctacggcccccgcgggc

SEQ ID NO: 733686 - DNA, 25 bp, Artificial sequence
  Synthetic oligonucleotide
cgcccccccgtccgcacgggctgcg

SEQ ID NO: 733687 - DNA, 25 bp, Artificial sequence
  Synthetic oligonucleotide
ccggaggcggaccgccgggcggctc

SEQ ID NO: 733688 - DNA, 25 bp, Artificial sequence
  Synthetic oligonucleotide
ccggaggcggacggccgggcggctc

SEQ ID NO: 733689 - DNA, 25 bp, Artificial sequence
  Synthetic oligonucleotide
cggaccgccccgctgccgggcaggc

SEQ ID NO: 733690 - DNA, 25 bp, Artificial sequence
  Synthetic oligonucleotide
cggaccgccccggtgccgggcaggc

SEQ ID NO: 733691 - DNA, 25 bp, Artificial sequence
  Synthetic oligonucleotide
gcggccgcgatccgcccccagcgcg

SEQ ID NO: 733692 - DNA, 25 bp, Artificial sequence
  Synthetic oligonucleotide
gcggccgcgatcggcccccagcgcg

SEQ ID NO: 733693 - DNA, 25 bp, Artificial sequence
  Synthetic oligonucleotide
gccacgccccgtggccgagcggggg

SEQ ID NO: 733694 - DNA, 25 bp, Artificial sequence
  Synthetic oligonucleotide
ctgggggcggccgccgtccgcgagc

SEQ ID NO: 733695 - DNA, 25 bp, Artificial sequence
  Synthetic oligonucleotide
cggcaggcgccgcccaacccgccgg

SEQ ID NO: 733696 - DNA, 25 bp, Artificial sequence
  Synthetic oligonucleotide
cgcccgcgcgtcgcgcctccggctg

SEQ ID NO: 733697 - DNA, 25 bp, Artificial sequence
  Synthetic oligonucleotide
tccacgacgcgcccgcccggccggg

SEQ ID NO: 733698 - DNA, 25 bp, Artificial sequence
  Synthetic oligonucleotide
tccacgacgcgcgcgcccggccggg

SEQ ID NO: 733699 - DNA, 25 bp, Artificial sequence
  Synthetic oligonucleotide
cccgtgccggcggcccccgtccgca

SEQ ID NO: 733700 - DNA, 25 bp, Artificial sequence
  Synthetic oligonucleotide
cccgtgccggcgccccccgtccgca

SEQ ID NO: 733701 - DNA, 25 bp, Artificial sequence
  Synthetic oligonucleotide
ggcctggcgccgctccgcgacgcgc

SEQ ID NO: 733702 - DNA, 25 bp, Artificial sequence
  Synthetic oligonucleotide
tggcctgccggcccgccgcgcccag

SEQ ID NO: 733703 - DNA, 25 bp, Artificial sequence
  Synthetic oligonucleotide
ggcctggcgccggtccgcgacgcgc

SEQ ID NO: 733704 - DNA, 25 bp, Artificial sequence
  Synthetic oligonucleotide
gcggggccgcgcgacggctcaggcc

SEQ ID NO: 733705 - DNA, 25 bp, Artificial sequence
  Synthetic oligonucleotide
gcggggccgcgccacggctcaggcc

SEQ ID NO: 733706 - DNA, 25 bp, Artificial sequence
  Synthetic oligonucleotide
ggcgcgccgtcgggcgccgctggct

SEQ ID NO: 733707 - DNA, 25 bp, Artificial sequence
  Synthetic oligonucleotide
ggcgcgccgtcgcgcgccgctggct

SEQ ID NO: 733708 - DNA, 25 bp, Artificial sequence
  Synthetic oligonucleotide
cgcccccccgtcggcacgggctgcg

SEQ ID NO: 733709 - DNA, 25 bp, Artificial sequence
  Synthetic oligonucleotide
ggacccgtcgcggcggcccgtgcgg

SEQ ID NO: 733710 - DNA, 25 bp, Artificial sequence
  Synthetic oligonucleotide
ctgggggcggcccccgtccgcgagc

SEQ ID NO: 733711 - DNA, 25 bp, Artificial sequence
  Synthetic oligonucleotide
gcgggccgtcgcctacgggccgccc

SEQ ID NO: 733712 - DNA, 25 bp, Artificial sequence
  Synthetic oligonucleotide
gcggggctccgcgggtacgcgccgg

SEQ ID NO: 733713 - DNA, 25 bp, Artificial sequence
  Synthetic oligonucleotide
gcggggctccgccggtacgcgccgg

SEQ ID NO: 733714 - DNA, 25 bp, Artificial sequence
  Synthetic oligonucleotide
gccgcgctacgcggcgtcggccggg

SEQ ID NO: 733715 - DNA, 25 bp, Artificial sequence
  Synthetic oligonucleotide
gccgcgctacgccgcgtcggccggg

SEQ ID NO: 733716 - DNA, 25 bp, Artificial sequence
  Synthetic oligonucleotide
ggcgcgcgtcgtacgcggggcccgc

SEQ ID NO: 733717 - DNA, 25 bp, Artificial sequence
  Synthetic oligonucleotide
ccggcgcctcgtacgggcggcgcgg

SEQ ID NO: 733718 - DNA, 25 bp, Artificial sequence
  Synthetic oligonucleotide
gcgggccgtcgcgtacgggccgccc

SEQ ID NO: 733719 - DNA, 25 bp, Artificial sequence
  Synthetic oligonucleotide
ggcgcggaccgatcgcgcgcgggcg

SEQ ID NO: 733720 - DNA, 25 bp, Artificial sequence
  Synthetic oligonucleotide
ccgcggcgtcgcgtacccgcgggcg

SEQ ID NO: 733721 - DNA, 25 bp, Artificial sequence
  Synthetic oligonucleotide
ccgcggcgtcgcctacccgcgggcg

SEQ ID NO: 733722 - DNA, 25 bp, Artificial sequence
  Synthetic oligonucleotide
gcgggccgtacgccggtcggccggc

SEQ ID NO: 733723 - DNA, 25 bp, Artificial sequence
  Synthetic oligonucleotide
gcgggccgtacggcggtcggccggc

SEQ ID NO: 733724 - DNA, 25 bp, Artificial sequence
  Synthetic oligonucleotide
cgggcgcggtgcgccgctacgccgc

SEQ ID NO: 733725 - DNA, 25 bp, Artificial sequence
  Synthetic oligonucleotide
cgggcgcggtgccccgctacgccgc

SEQ ID NO: 733726 - DNA, 25 bp, Artificial sequence
  Synthetic oligonucleotide
ggcgcgcgtcgttcgcggggcccgc

SEQ ID NO: 733727 - DNA, 25 bp, Artificial sequence
  Synthetic oligonucleotide
cggcgggcccgtggcacgaggcgcc

SEQ ID NO: 733728 - DNA, 25 bp, Artificial sequence
  Synthetic oligonucleotide
cgggccgcgcggacgcgtagccggg

SEQ ID NO: 733729 - DNA, 25 bp, Artificial sequence
  Synthetic oligonucleotide
gccccggcgcgaaaccccccgcgcg

SEQ ID NO: 733730 - DNA, 25 bp, Artificial sequence
  Synthetic oligonucleotide
gccccggcgcgataccccccgcgcg

SEQ ID NO: 733731 - DNA, 25 bp, Artificial sequence
  Synthetic oligonucleotide
ggcggggcgcgagtcccgacccgcg

SEQ ID NO: 733732 - DNA, 25 bp, Artificial sequence
  Synthetic oligonucleotide
ggcggggcgcgactcccgacccgcg

SEQ ID NO: 733733 - DNA, 25 bp, Artificial sequence
  Synthetic oligonucleotide
gggggggcctagctccgcgcgcgcg

SEQ ID NO: 733734 - DNA, 25 bp, Artificial sequence
  Synthetic oligonucleotide
cgccccctcgacggcgcgagccccc

SEQ ID NO: 733735 - DNA, 25 bp, Artificial sequence
  Synthetic oligonucleotide
cggcgggcccgtcgcacgaggcgcc

SEQ ID NO: 733736 - DNA, 25 bp, Artificial sequence
  Synthetic oligonucleotide
cgccccctcgaccgcgcgagccccc

SEQ ID NO: 733737 - DNA, 25 bp, Artificial sequence
  Synthetic oligonucleotide
gggcgcgcacgcggacgtcgcgccc

SEQ ID NO: 733738 - DNA, 25 bp, Artificial sequence
  Synthetic oligonucleotide
gggcgcgcacgccgacgtcgcgccc

SEQ ID NO: 733739 - DNA, 25 bp, Artificial sequence
  Synthetic oligonucleotide
cggcgggaccggcgtagcgcgcccc

SEQ ID NO: 733740 - DNA, 25 bp, Artificial sequence
  Synthetic oligonucleotide
cggcgggaccggggtagcgcgcccc

SEQ ID NO: 733741 - DNA, 25 bp, Artificial sequence
  Synthetic oligonucleotide
ggcgcggaccgaacgcgcgcgggcg

SEQ ID NO: 733742 - DNA, 25 bp, Artificial sequence
  Synthetic oligonucleotide
tgcgccccgggcgggacggcctgcc

SEQ ID NO: 733743 - DNA, 25 bp, Artificial sequence
  Synthetic oligonucleotide
gggggggcctaggtccgcgcgcgcg

SEQ ID NO: 733744 - DNA, 25 bp, Artificial sequence
  Synthetic oligonucleotide
gcggcgcgacgtacgccccgccccg

SEQ ID NO: 733745 - DNA, 25 bp, Artificial sequence
  Synthetic oligonucleotide
gccgcgcggtccaacgcgggccgcg

SEQ ID NO: 733746 - DNA, 25 bp, Artificial sequence
  Synthetic oligonucleotide
cgggcccgccggaacacggcgcggc

SEQ ID NO: 733747 - DNA, 25 bp, Artificial sequence
  Synthetic oligonucleotide
gcggggcgcccgttagcgcgcgcgg

SEQ ID NO: 733748 - DNA, 25 bp, Artificial sequence
  Synthetic oligonucleotide
gcggggcgcccgatagcgcgcgcgg

SEQ ID NO: 733749 - DNA, 25 bp, Artificial sequence
  Synthetic oligonucleotide
ggcccgcgcccgaacggagccgccc

SEQ ID NO: 733750 - DNA, 25 bp, Artificial sequence
  Synthetic oligonucleotide
ggcccgcgcccgtacggagccgccc

SEQ ID NO: 733751 - DNA, 25 bp, Artificial sequence
  Synthetic oligonucleotide
cgggcgcgcgaccgtgcgacgcccc

SEQ ID NO: 733752 - DNA, 25 bp, Artificial sequence
  Synthetic oligonucleotide
gccgggcgatcccacgccgggcgcg

SEQ ID NO: 733753 - DNA, 25 bp, Artificial sequence
  Synthetic oligonucleotide
cgggcgcgcgacggtgcgacgcccc

SEQ ID NO: 733754 - DNA, 25 bp, Artificial sequence
  Synthetic oligonucleotide
gcggcgcgacgttcgccccgccccg

SEQ ID NO: 733755 - DNA, 25 bp, Artificial sequence
  Synthetic oligonucleotide
cgggcgcgacggctccgcacggcgc

SEQ ID NO: 733756 - DNA, 25 bp, Artificial sequence
  Synthetic oligonucleotide
cgggcgcgacgggtccgcacggcgc

SEQ ID NO: 733757 - DNA, 25 bp, Artificial sequence
  Synthetic oligonucleotide
gggccgcgacccgctagcggccgcc

SEQ ID NO: 733758 - DNA, 25 bp, Artificial sequence
  Synthetic oligonucleotide
gggccgcgaccccctagcggccgcc

SEQ ID NO: 733759 - DNA, 25 bp, Artificial sequence
  Synthetic oligonucleotide
ccggcgcctcgttcgggcggcgcgg

SEQ ID NO: 733760 - DNA, 25 bp, Artificial sequence
  Synthetic oligonucleotide
gccgggcgatccgacgccgggcgcg

SEQ ID NO: 733761 - DNA, 25 bp, Artificial sequence
  Synthetic oligonucleotide
gcgcgccgcgtaacggcccgccgcc

SEQ ID NO: 733762 - DNA, 25 bp, Artificial sequence
  Synthetic oligonucleotide
cgccccgcgtcgtacgggcgcggcc

SEQ ID NO: 733763 - DNA, 25 bp, Artificial sequence
  Synthetic oligonucleotide
ggccggcgggagcgctcgagcccgc

SEQ ID NO: 733764 - DNA, 25 bp, Artificial sequence
  Synthetic oligonucleotide
gcggcgcgcgtggcgtacccgcggc

SEQ ID NO: 733765 - DNA, 25 bp, Artificial sequence
  Synthetic oligonucleotide
gcggcccgcgtccagggaccgcggc

SEQ ID NO: 733766 - DNA, 25 bp, Artificial sequence
  Synthetic oligonucleotide
gcggcccgcgtcgagggaccgcggc

SEQ ID NO: 733767 - DNA, 25 bp, Artificial sequence
  Synthetic oligonucleotide
gcggcccgcgtccacgcgtccgggc

SEQ ID NO: 733768 - DNA, 25 bp, Artificial sequence
  Synthetic oligonucleotide
cgggcccgccggtacacggcgcggc

SEQ ID NO: 733769 - DNA, 25 bp, Artificial sequence
  Synthetic oligonucleotide
gcgcgccgcgtatcggcccgccgcc

SEQ ID NO: 733770 - DNA, 25 bp, Artificial sequence
  Synthetic oligonucleotide
gccgcgcggtcctacgcgggccgcg

SEQ ID NO: 733771 - DNA, 25 bp, Artificial sequence
  Synthetic oligonucleotide
gcggcccgcgtacgaccgcgcgccc

SEQ ID NO: 733772 - DNA, 25 bp, Artificial sequence
  Synthetic oligonucleotide
gcggcccgcgtaggaccgcgcgccc

SEQ ID NO: 733773 - DNA, 25 bp, Artificial sequence
  Synthetic oligonucleotide
ccgcgccgcggttgcggtcggcggg

SEQ ID NO: 733774 - DNA, 25 bp, Artificial sequence
  Synthetic oligonucleotide
ccgcgccgcggtagcggtcggcggg

SEQ ID NO: 733775 - DNA, 25 bp, Artificial sequence
  Synthetic oligonucleotide
ggccggcgcggttcgacggcgcccc

SEQ ID NO: 733776 - DNA, 25 bp, Artificial sequence
  Synthetic oligonucleotide
ggccggcgcggtacgacggcgcccc

SEQ ID NO: 733777 - DNA, 25 bp, Artificial sequence
  Synthetic oligonucleotide
gcggcccgcgtcgacgcgtccgggc

SEQ ID NO: 733778 - DNA, 25 bp, Artificial sequence
  Synthetic oligonucleotide
ggccccgtcggcgcatcgcccgccg

SEQ ID NO: 733779 - DNA, 25 bp, Artificial sequence
  Synthetic oligonucleotide
cgggcctcggcgctcacggcgccgg

SEQ ID NO: 733780 - DNA, 25 bp, Artificial sequence
  Synthetic oligonucleotide
gcgccggtcgcaagcgcggcccgcg

SEQ ID NO: 733781 - DNA, 25 bp, Artificial sequence
  Synthetic oligonucleotide
gggcgggtcgcgaccgcctggccgg

SEQ ID NO: 733782 - DNA, 25 bp, Artificial sequence
  Synthetic oligonucleotide
gggcgggtcgcgtccgcctggccgg

SEQ ID NO: 733783 - DNA, 25 bp, Artificial sequence
  Synthetic oligonucleotide
ccgcgcgtcgcggccgtaccggccc

SEQ ID NO: 733784 - DNA, 25 bp, Artificial sequence
  Synthetic oligonucleotide
ccgcgcgtcgcgcccgtaccggccc

SEQ ID NO: 733785 - DNA, 25 bp, Artificial sequence
  Synthetic oligonucleotide
ccggcggtcgaccgcgcgaggcccg

SEQ ID NO: 733786 - DNA, 25 bp, Artificial sequence
  Synthetic oligonucleotide
ggcggggtcgcgcgtacgggccggc

SEQ ID NO: 733787 - DNA, 25 bp, Artificial sequence
  Synthetic oligonucleotide
ccggcggtcgacggcgcgaggcccg

SEQ ID NO: 733788 - DNA, 25 bp, Artificial sequence
  Synthetic oligonucleotide
ggccccgtcggcccatcgcccgccg

SEQ ID NO: 733789 - DNA, 25 bp, Artificial sequence
  Synthetic oligonucleotide
gcgcccgtgcgcccgatcggcggcg

SEQ ID NO: 733790 - DNA, 25 bp, Artificial sequence
  Synthetic oligonucleotide
cccgcctgcgcgcgccgtacggccc

SEQ ID NO: 733791 - DNA, 25 bp, Artificial sequence
  Synthetic oligonucleotide
cggccctcgtaccccgggcggcgcc

SEQ ID NO: 733792 - DNA, 25 bp, Artificial sequence
  Synthetic oligonucleotide
cggccctcgtacgccgggcggcgcc

SEQ ID NO: 733793 - DNA, 25 bp, Artificial sequence
  Synthetic oligonucleotide
cgggccgcgcggtcgcgtagccggg

SEQ ID NO: 733794 - DNA, 25 bp, Artificial sequence
  Synthetic oligonucleotide
ggcggggtcgcgggtacgggccggc

SEQ ID NO: 733795 - DNA, 25 bp, Artificial sequence
  Synthetic oligonucleotide
ggccggttcgccggcgggtggcggc

SEQ ID NO: 733796 - DNA, 25 bp, Artificial sequence
  Synthetic oligonucleotide
gcgcaccccccgggtcgagcgcccg

SEQ ID NO: 733797 - DNA, 25 bp, Artificial sequence
  Synthetic oligonucleotide
gcgcgaccacgcgggacgggccccc

SEQ ID NO: 733798 - DNA, 25 bp, Artificial sequence
  Synthetic oligonucleotide
gcgcgaccacgccggacgggccccc

SEQ ID NO: 733799 - DNA, 25 bp, Artificial sequence
  Synthetic oligonucleotide
tgggggacggccggtccgcggcgcc

SEQ ID NO: 733800 - DNA, 25 bp, Artificial sequence
  Synthetic oligonucleotide
tgggggacggcccgtccgcggcgcc

SEQ ID NO: 733801 - DNA, 25 bp, Artificial sequence
  Synthetic oligonucleotide
ccggcgttgcgcgggacggcgcgcc

SEQ ID NO: 733802 - DNA, 25 bp, Artificial sequence
  Synthetic oligonucleotide
gcgccggtcgcatgcgcggcccgcg

SEQ ID NO: 733803 - DNA, 25 bp, Artificial sequence
  Synthetic oligonucleotide
ggccggttcgcccgcgggtggcggc

SEQ ID NO: 733804 - DNA, 25 bp, Artificial sequence
  Synthetic oligonucleotide
ggcgggtcgcggccgatcccggcgg

SEQ ID NO: 733805 - DNA, 25 bp, Artificial sequence
  Synthetic oligonucleotide
ggggcctggcggacgcacgcgcgcc

SEQ ID NO: 733806 - DNA, 25 bp, Artificial sequence
  Synthetic oligonucleotide
ggggcctggcggtcgcacgcgcgcc

SEQ ID NO: 733807 - DNA, 25 bp, Artificial sequence
  Synthetic oligonucleotide
cgcgggtgcgcgctcgcgagcgcgc

SEQ ID NO: 733808 - DNA, 25 bp, Artificial sequence
  Synthetic oligonucleotide
cgcgggtgcgcggtcgcgagcgcgc

SEQ ID NO: 733809 - DNA, 25 bp, Artificial sequence
  Synthetic oligonucleotide
cccgcctgcgcgggccgtacggccc

SEQ ID NO: 733810 - DNA, 25 bp, Artificial sequence
  Synthetic oligonucleotide
gccgcgggtctcgaccgcggccgcg

SEQ ID NO: 733811 - DNA, 25 bp, Artificial sequence
  Synthetic oligonucleotide
ccggcgttgcgccggacggcgcgcc

SEQ ID NO: 733812 - DNA, 25 bp, Artificial sequence
  Synthetic oligonucleotide
cgccgcggcccgaacgacggcgccg

SEQ ID NO: 733813 - DNA, 25 bp, Artificial sequence
  Synthetic oligonucleotide
cgggcctcggcggtcacggcgccgg

SEQ ID NO: 733814 - DNA, 25 bp, Artificial sequence
  Synthetic oligonucleotide
cgcgcgggcgtcgtcccgaccgggc

SEQ ID NO: 733815 - DNA, 25 bp, Artificial sequence
  Synthetic oligonucleotide
cgccccggcggtgcgctaggcggcg

SEQ ID NO: 733816 - DNA, 25 bp, Artificial sequence
  Synthetic oligonucleotide
cgccccggcggtccgctaggcggcg

SEQ ID NO: 733817 - DNA, 25 bp, Artificial sequence
  Synthetic oligonucleotide
ccgccgggcgcgggctagtccccgc

SEQ ID NO: 733818 - DNA, 25 bp, Artificial sequence
  Synthetic oligonucleotide
ccgccgggcgcgcgctagtccccgc

SEQ ID NO: 733819 - DNA, 25 bp, Artificial sequence
  Synthetic oligonucleotide
gccgccggggcgtcgaacgcgcggg

SEQ ID NO: 733820 - DNA, 25 bp, Artificial sequence
  Synthetic oligonucleotide
gcccgcggcgatgcgacgggccgcc

SEQ ID NO: 733821 - DNA, 25 bp, Artificial sequence
  Synthetic oligonucleotide
gccgccggggcgacgaacgcgcggg

SEQ ID NO: 733822 - DNA, 25 bp, Artificial sequence
  Synthetic oligonucleotide
cgccgcggcccgtacgacggcgccg

SEQ ID NO: 733823 - DNA, 25 bp, Artificial sequence
  Synthetic oligonucleotide
ggccgggctaggggccgcacccggg

SEQ ID NO: 733824 - DNA, 25 bp, Artificial sequence
  Synthetic oligonucleotide
ggccgggctaggcgccgcacccggg

SEQ ID NO: 733825 - DNA, 25 bp, Artificial sequence
  Synthetic oligonucleotide
cggggggcgttcccggcacgccggc

SEQ ID NO: 733826 - DNA, 25 bp, Artificial sequence
  Synthetic oligonucleotide
cggggggcgttcgcggcacgccggc

SEQ ID NO: 733827 - DNA, 25 bp, Artificial sequence
  Synthetic oligonucleotide
gcgggcggtaggcgcaccgccggcg

SEQ ID NO: 733828 - DNA, 25 bp, Artificial sequence
  Synthetic oligonucleotide
gcccgcggcgatccgacgggccgcc

SEQ ID NO: 733829 - DNA, 25 bp, Artificial sequence
  Synthetic oligonucleotide
cggccacgtctggccggcgggcgcc

SEQ ID NO: 733830 - DNA, 25 bp, Artificial sequence
  Synthetic oligonucleotide
ggcgggtcgcgggcgatcccggcgg

SEQ ID NO: 733831 - DNA, 25 bp, Artificial sequence
  Synthetic oligonucleotide
gccccctccacgggtcgcggccccg

SEQ ID NO: 733832 - DNA, 25 bp, Artificial sequence
  Synthetic oligonucleotide
gccccctccacgcgtcgcggccccg

SEQ ID NO: 733833 - DNA, 25 bp, Artificial sequence
  Synthetic oligonucleotide
cggcgctaggcgacgcggcccgccc

SEQ ID NO: 733834 - DNA, 25 bp, Artificial sequence
  Synthetic oligonucleotide
cggcgctaggcgtcgcggcccgccc

SEQ ID NO: 733835 - DNA, 25 bp, Artificial sequence
  Synthetic oligonucleotide
ccgccgtagcgagcccgcggcccgc

SEQ ID NO: 733836 - DNA, 25 bp, Artificial sequence
  Synthetic oligonucleotide
cgcgcgggcgtcctcccgaccgggc

SEQ ID NO: 733837 - DNA, 25 bp, Artificial sequence
  Synthetic oligonucleotide
gcgcccgtgcgcgcgatcggcggcg

SEQ ID NO: 733838 - DNA, 25 bp, Artificial sequence
  Synthetic oligonucleotide
cgccccgcgtcgaacgggcgcggcc

SEQ ID NO: 733839 - DNA, 25 bp, Artificial sequence
  Synthetic oligonucleotide
ggccggcgggagggctcgagcccgc

SEQ ID NO: 733840 - DNA, 25 bp, Artificial sequence
  Synthetic oligonucleotide
gccgcgggtctccaccgcggccgcg

SEQ ID NO: 733841 - DNA, 25 bp, Artificial sequence
  Synthetic oligonucleotide
ggcgggggtcgcgcggtagcgggcc

SEQ ID NO: 733842 - DNA, 25 bp, Artificial sequence
  Synthetic oligonucleotide
gcgggcggtaggggcaccgccggcg

SEQ ID NO: 733843 - DNA, 25 bp, Artificial sequence
  Synthetic oligonucleotide
gggggcggtacgggctccgccccgc

SEQ ID NO: 733844 - DNA, 25 bp, Artificial sequence
  Synthetic oligonucleotide
gggggcggtacgcgctccgccccgc

SEQ ID NO: 733845 - DNA, 25 bp, Artificial sequence
  Synthetic oligonucleotide
ccgccgtagcgaccccgcggcccgc

SEQ ID NO: 733846 - DNA, 25 bp, Artificial sequence
  Synthetic oligonucleotide
cccgcacccggccgtcgcaccccgc

SEQ ID NO: 733847 - DNA, 25 bp, Artificial sequence
  Synthetic oligonucleotide
acggcgggggctggcagccgcgccg

SEQ ID NO: 733848 - DNA, 25 bp, Artificial sequence
  Synthetic oligonucleotide
ccggggcccactggcggcgcgcgac

SEQ ID NO: 733849 - DNA, 25 bp, Artificial sequence
  Synthetic oligonucleotide
ccggggcccactcgcggcgcgcgac

SEQ ID NO: 733850 - DNA, 25 bp, Artificial sequence
  Synthetic oligonucleotide
ccccccgtgcgacgacgcccggcgc

SEQ ID NO: 733851 - DNA, 25 bp, Artificial sequence
  Synthetic oligonucleotide
ccccccgtgcgaggacgcccggcgc

SEQ ID NO: 733852 - DNA, 25 bp, Artificial sequence
  Synthetic oligonucleotide
gcgggctgtccgccggtgggccccc

SEQ ID NO: 733853 - DNA, 25 bp, Artificial sequence
  Synthetic oligonucleotide
gccggctacgggcgggccgcgcacc

SEQ ID NO: 733854 - DNA, 25 bp, Artificial sequence
  Synthetic oligonucleotide
cccgcacccggcggtcgcaccccgc

SEQ ID NO: 733855 - DNA, 25 bp, Artificial sequence
  Synthetic oligonucleotide
cgggccgtcgcgggacgcgccaggg

SEQ ID NO: 733856 - DNA, 25 bp, Artificial sequence
  Synthetic oligonucleotide
gcgggagcccccccgcgcgtcccgt

SEQ ID NO: 733857 - DNA, 25 bp, Artificial sequence
  Synthetic oligonucleotide
gcgggagcccccgcgcgcgtcccgt

SEQ ID NO: 733858 - DNA, 25 bp, Artificial sequence
  Synthetic oligonucleotide
cgcccgctggacgagcggcgcgccg

SEQ ID NO: 733859 - DNA, 25 bp, Artificial sequence
  Synthetic oligonucleotide
cgcccgctggaccagcggcgcgccg

SEQ ID NO: 733860 - DNA, 25 bp, Artificial sequence
  Synthetic oligonucleotide
gcgcgaccgccgcgccggcagccac

SEQ ID NO: 733861 - DNA, 25 bp, Artificial sequence
  Synthetic oligonucleotide
cgggcgcgacgggcgtcggcctccc

SEQ ID NO: 733862 - DNA, 25 bp, Artificial sequence
  Synthetic oligonucleotide
gcgggctgtccggcggtgggccccc

SEQ ID NO: 733863 - DNA, 25 bp, Artificial sequence
  Synthetic oligonucleotide
ccggcggcgacgggcccgtgcgagc

SEQ ID NO: 733864 - DNA, 25 bp, Artificial sequence
  Synthetic oligonucleotide
cccgcgcgcgcggcgtacggcctcc

SEQ ID NO: 733865 - DNA, 25 bp, Artificial sequence
  Synthetic oligonucleotide
cccgcgcgcgcgccgtacggcctcc

SEQ ID NO: 733866 - DNA, 25 bp, Artificial sequence
  Synthetic oligonucleotide
cgcgcccgcgtacgcgcggcccctc

SEQ ID NO: 733867 - DNA, 25 bp, Artificial sequence
  Synthetic oligonucleotide
cgcgcccgcgtaggcgcggcccctc

SEQ ID NO: 733868 - DNA, 25 bp, Artificial sequence
  Synthetic oligonucleotide
accccgcgcgtccggcgcagggcgg

SEQ ID NO: 733869 - DNA, 25 bp, Artificial sequence
  Synthetic oligonucleotide
accccgcgcgtcgggcgcagggcgg

SEQ ID NO: 733870 - DNA, 25 bp, Artificial sequence
  Synthetic oligonucleotide
gccggctacgggggggccgcgcacc

SEQ ID NO: 733871 - DNA, 25 bp, Artificial sequence
  Synthetic oligonucleotide
cgccgcgcccgtacgggcgagccgg

SEQ ID NO: 733872 - DNA, 25 bp, Artificial sequence
  Synthetic oligonucleotide
acggcgggggctcgcagccgcgccg

SEQ ID NO: 733873 - DNA, 25 bp, Artificial sequence
  Synthetic oligonucleotide
ccggcggcgacgcgcccgtgcgagc

SEQ ID NO: 733874 - DNA, 25 bp, Artificial sequence
  Synthetic oligonucleotide
tccggcgcgtcggaccgcggcgccg

SEQ ID NO: 733875 - DNA, 25 bp, Artificial sequence
  Synthetic oligonucleotide
tccggcgcgtcgcaccgcggcgccg

SEQ ID NO: 733876 - DNA, 25 bp, Artificial sequence
  Synthetic oligonucleotide
cagggggggcgttcccgcgcgcgcg

SEQ ID NO: 733877 - DNA, 25 bp, Artificial sequence
  Synthetic oligonucleotide
cagggggggcgtacccgcgcgcgcg

SEQ ID NO: 733878 - DNA, 25 bp, Artificial sequence
  Synthetic oligonucleotide
cgggccgtcgcgcgacgcgccaggg

SEQ ID NO: 733879 - DNA, 25 bp, Artificial sequence
  Synthetic oligonucleotide
cgccgcgcccgttcgggcgagccgg

SEQ ID NO: 733880 - DNA, 25 bp, Artificial sequence
  Synthetic oligonucleotide
ccggccggactgggccgccgcggga

SEQ ID NO: 733881 - DNA, 25 bp, Artificial sequence
  Synthetic oligonucleotide
gcgcgaccgccgggccggcagccac

SEQ ID NO: 733882 - DNA, 25 bp, Artificial sequence
  Synthetic oligonucleotide
gcccccggtcgcagccagcgggcgg

SEQ ID NO: 733883 - DNA, 25 bp, Artificial sequence
  Synthetic oligonucleotide
gcccccggtcgctgccagcgggcgg

SEQ ID NO: 733884 - DNA, 25 bp, Artificial sequence
  Synthetic oligonucleotide
cgccgtcggccggccgcacgctcgg

SEQ ID NO: 733885 - DNA, 25 bp, Artificial sequence
  Synthetic oligonucleotide
cgccgccctagcggcggacggcgcg

SEQ ID NO: 733886 - DNA, 25 bp, Artificial sequence
  Synthetic oligonucleotide
cgccgtcggccgcccgcacgctcgg

SEQ ID NO: 733887 - DNA, 25 bp, Artificial sequence
  Synthetic oligonucleotide
ggccagccggtgcgggacccgccgg

SEQ ID NO: 733888 - DNA, 25 bp, Artificial sequence
  Synthetic oligonucleotide
ccggccggactgcgccgccgcggga

SEQ ID NO: 733889 - DNA, 25 bp, Artificial sequence
  Synthetic oligonucleotide
ccccggctcgagcgggccggtcgcc

SEQ ID NO: 733890 - DNA, 25 bp, Artificial sequence
  Synthetic oligonucleotide
ccgcgatggcgccgcccctcgggcg

SEQ ID NO: 733891 - DNA, 25 bp, Artificial sequence
  Synthetic oligonucleotide
ccgcgatggcgcggcccctcgggcg

SEQ ID NO: 733892 - DNA, 25 bp, Artificial sequence
  Synthetic oligonucleotide
cgcctgcgtcccccccctgggcgcg

SEQ ID NO: 733893 - DNA, 25 bp, Artificial sequence
  Synthetic oligonucleotide
cgcctgcgtcccgcccctgggcgcg

SEQ ID NO: 733894 - DNA, 25 bp, Artificial sequence
  Synthetic oligonucleotide
tgcggaggggccgcgcaccggcgcg

SEQ ID NO: 733895 - DNA, 25 bp, Artificial sequence
  Synthetic oligonucleotide
tgcggaggggccccgcaccggcgcg

SEQ ID NO: 733896 - DNA, 25 bp, Artificial sequence
  Synthetic oligonucleotide
ggcgggggtcgcccggtagcgggcc

SEQ ID NO: 733897 - DNA, 25 bp, Artificial sequence
  Synthetic oligonucleotide
cgcgctacgcggggcccccccacgc

SEQ ID NO: 733898 - DNA, 25 bp, Artificial sequence
  Synthetic oligonucleotide
ggggccgccggcgcgcggcagtgtg

SEQ ID NO: 733899 - DNA, 25 bp, Artificial sequence
  Synthetic oligonucleotide
ggggccgccggcccgcggcagtgtg

SEQ ID NO: 733900 - DNA, 25 bp, Artificial sequence
  Synthetic oligonucleotide
ccccacactcccgcggcggccgggc

SEQ ID NO: 733901 - DNA, 25 bp, Artificial sequence
  Synthetic oligonucleotide
gcctcggacgcctccggcgcggcgg

SEQ ID NO: 733902 - DNA, 25 bp, Artificial sequence
  Synthetic oligonucleotide
ccacagcccccccacgcgcggcgcc

SEQ ID NO: 733903 - DNA, 25 bp, Artificial sequence
  Synthetic oligonucleotide
ccacagccccccgacgcgcggcgcc

SEQ ID NO: 733904 - DNA, 25 bp, Artificial sequence
  Synthetic oligonucleotide
ggccagccggtgggggacccgccgg

SEQ ID NO: 733905 - DNA, 25 bp, Artificial sequence
  Synthetic oligonucleotide
cgtcggcgcgcccaggcgacccccg

SEQ ID NO: 733906 - DNA, 25 bp, Artificial sequence
  Synthetic oligonucleotide
ccccacactcccccggcggccgggc

SEQ ID NO: 733907 - DNA, 25 bp, Artificial sequence
  Synthetic oligonucleotide
cgcgctacgcggcgcccccccacgc

SEQ ID NO: 733908 - DNA, 25 bp, Artificial sequence
  Synthetic oligonucleotide
ccgccgcccgccggcggtgtctgcc

SEQ ID NO: 733909 - DNA, 25 bp, Artificial sequence
  Synthetic oligonucleotide
ccgccgcccgcccgcggtgtctgcc

SEQ ID NO: 733910 - DNA, 25 bp, Artificial sequence
  Synthetic oligonucleotide
gccggtgggcggcccacgcgcctcg

SEQ ID NO: 733911 - DNA, 25 bp, Artificial sequence
  Synthetic oligonucleotide
gccggtgggcgggccacgcgcctcg

SEQ ID NO: 733912 - DNA, 25 bp, Artificial sequence
  Synthetic oligonucleotide
ccccggctcgagggggccggtcgcc

SEQ ID NO: 733913 - DNA, 25 bp, Artificial sequence
  Synthetic oligonucleotide
cgtcggcgcgccgaggcgacccccg

SEQ ID NO: 733914 - DNA, 25 bp, Artificial sequence
  Synthetic oligonucleotide
gcgggcccgccccacgatcccgcgg

SEQ ID NO: 733915 - DNA, 25 bp, Artificial sequence
  Synthetic oligonucleotide
ggcgcgccgcgggtatgcccccccg

SEQ ID NO: 733916 - DNA, 25 bp, Artificial sequence
  Synthetic oligonucleotide
gggcccccgcggcgcatacgggcgc

SEQ ID NO: 733917 - DNA, 25 bp, Artificial sequence
  Synthetic oligonucleotide
gccgcgccgcgccacgaacggcggc

SEQ ID NO: 733918 - DNA, 25 bp, Artificial sequence
  Synthetic oligonucleotide
gccgcgccgcgcgacgaacggcggc

SEQ ID NO: 733919 - DNA, 25 bp, Artificial sequence
  Synthetic oligonucleotide
cggccgccgcgaggcgtgaggcgcc

SEQ ID NO: 733920 - DNA, 25 bp, Artificial sequence
  Synthetic oligonucleotide
cggccgccgcgacgcgtgaggcgcc

SEQ ID NO: 733921 - DNA, 25 bp, Artificial sequence
  Synthetic oligonucleotide
gccccgccgaccggtacgcgggcgc

SEQ ID NO: 733922 - DNA, 25 bp, Artificial sequence
  Synthetic oligonucleotide
ccggccccgccggcacgtaccgcgc

SEQ ID NO: 733923 - DNA, 25 bp, Artificial sequence
  Synthetic oligonucleotide
ggcgcgccgcggctatgcccccccg

SEQ ID NO: 733924 - DNA, 25 bp, Artificial sequence
  Synthetic oligonucleotide
gcgggcccgcccgacgatcccgcgg

SEQ ID NO: 733925 - DNA, 25 bp, Artificial sequence
  Synthetic oligonucleotide
cccgccccgagccctacgcgcgcgg

SEQ ID NO: 733926 - DNA, 25 bp, Artificial sequence
  Synthetic oligonucleotide
cccgccccgagcgctacgcgcgcgg

SEQ ID NO: 733927 - DNA, 25 bp, Artificial sequence
  Synthetic oligonucleotide
cccgccccgacgggagcgtgcgggc

SEQ ID NO: 733928 - DNA, 25 bp, Artificial sequence
  Synthetic oligonucleotide
cccgccccgacgcgagcgtgcgggc

SEQ ID NO: 733929 - DNA, 25 bp, Artificial sequence
  Synthetic oligonucleotide
gccccgccgacccgtacgcgggcgc

SEQ ID NO: 733930 - DNA, 25 bp, Artificial sequence
  Synthetic oligonucleotide
ccggccccgccgccacgtaccgcgc

SEQ ID NO: 733931 - DNA, 25 bp, Artificial sequence
  Synthetic oligonucleotide
cccggcccggcaggctacgcgcccg

SEQ ID NO: 733932 - DNA, 25 bp, Artificial sequence
  Synthetic oligonucleotide
cgccgccctagccgcggacggcgcg

SEQ ID NO: 733933 - DNA, 25 bp, Artificial sequence
  Synthetic oligonucleotide
cgccggccgttccggcgagcgccgc

SEQ ID NO: 733934 - DNA, 25 bp, Artificial sequence
  Synthetic oligonucleotide
cgccggccgttcgggcgagcgccgc

SEQ ID NO: 733935 - DNA, 25 bp, Artificial sequence
  Synthetic oligonucleotide
cccggcccgtcgttgcgcgcgggcg

SEQ ID NO: 733936 - DNA, 25 bp, Artificial sequence
  Synthetic oligonucleotide
cccggcccgtcgatgcgcgcgggcg

SEQ ID NO: 733937 - DNA, 25 bp, Artificial sequence
  Synthetic oligonucleotide
ccgcggccggtcggcgctaccgcgc

SEQ ID NO: 733938 - DNA, 25 bp, Artificial sequence
  Synthetic oligonucleotide
cgggcgcgacggccgtcggcctccc

SEQ ID NO: 733939 - DNA, 25 bp, Artificial sequence
  Synthetic oligonucleotide
cccggcccggcacgctacgcgcccg

SEQ ID NO: 733940 - DNA, 25 bp, Artificial sequence
  Synthetic oligonucleotide
gcctcggacgccaccggcgcggcgg

SEQ ID NO: 733941 - DNA, 25 bp, Artificial sequence
  Synthetic oligonucleotide
gcggggccggatcaccgcgccgcgg

SEQ ID NO: 733942 - DNA, 25 bp, Artificial sequence
  Synthetic oligonucleotide
gcggggccggatgaccgcgccgcgg

SEQ ID NO: 733943 - DNA, 25 bp, Artificial sequence
  Synthetic oligonucleotide
cccgcgccgcgtctcgacccccgcg

SEQ ID NO: 733944 - DNA, 25 bp, Artificial sequence
  Synthetic oligonucleotide
cccgcgccgcgtgtcgacccccgcg

SEQ ID NO: 733945 - DNA, 25 bp, Artificial sequence
  Synthetic oligonucleotide
cccgccccgcgtttcgccgcgcccc

SEQ ID NO: 733946 - DNA, 25 bp, Artificial sequence
  Synthetic oligonucleotide
cccgccccgcgtatcgccgcgcccc

SEQ ID NO: 733947 - DNA, 25 bp, Artificial sequence
  Synthetic oligonucleotide
gggcccccgcggggcatacgggcgc

SEQ ID NO: 733948 - DNA, 25 bp, Artificial sequence
  Synthetic oligonucleotide
ccgcggccggtccgcgctaccgcgc

SEQ ID NO: 733949 - DNA, 25 bp, Artificial sequence
  Synthetic oligonucleotide
cgcgccccggaccggtcgccgccga

SEQ ID NO: 733950 - DNA, 25 bp, Artificial sequence
  Synthetic oligonucleotide
cggccgacgcccctcgcgaccgccg

SEQ ID NO: 733951 - DNA, 25 bp, Artificial sequence
  Synthetic oligonucleotide
ccccgcacccggcgtagcggcgcgc

SEQ ID NO: 733952 - DNA, 25 bp, Artificial sequence
  Synthetic oligonucleotide
ggcgcgaacccggtcgcccgcgccg

SEQ ID NO: 733953 - DNA, 25 bp, Artificial sequence
  Synthetic oligonucleotide
ggcgccatcgcgggagcgggcgggc

SEQ ID NO: 733954 - DNA, 25 bp, Artificial sequence
  Synthetic oligonucleotide
ggcgcgaacccgctcgcccgcgccg

SEQ ID NO: 733955 - DNA, 25 bp, Artificial sequence
  Synthetic oligonucleotide
gcgaggccggccgtacggcgcgcgg

SEQ ID NO: 733956 - DNA, 25 bp, Artificial sequence
  Synthetic oligonucleotide
gcgcaccccccgcgtcgagcgcccg

SEQ ID NO: 733957 - DNA, 25 bp, Artificial sequence
  Synthetic oligonucleotide
cgcgccccggacgggtcgccgccga

SEQ ID NO: 733958 - DNA, 25 bp, Artificial sequence
  Synthetic oligonucleotide
cggcccacgcgcgcggttgcgggcc

SEQ ID NO: 733959 - DNA, 25 bp, Artificial sequence
  Synthetic oligonucleotide
gcccgcccgacgcgcggtgcgcctc

SEQ ID NO: 733960 - DNA, 25 bp, Artificial sequence
  Synthetic oligonucleotide
gcccgcccgacgggcggtgcgcctc

SEQ ID NO: 733961 - DNA, 25 bp, Artificial sequence
  Synthetic oligonucleotide
gagccgcccgcgagtcgcgcgcgcg

SEQ ID NO: 733962 - DNA, 25 bp, Artificial sequence
  Synthetic oligonucleotide
gagccgcccgcgtgtcgcgcgcgcg

SEQ ID NO: 733963 - DNA, 25 bp, Artificial sequence
  Synthetic oligonucleotide
cggcggccccgtagcgcggaggccg

SEQ ID NO: 733964 - DNA, 25 bp, Artificial sequence
  Synthetic oligonucleotide
cggcggccccgttgcgcggaggccg

SEQ ID NO: 733965 - DNA, 25 bp, Artificial sequence
  Synthetic oligonucleotide
gcgaggccggccctacggcgcgcgg

SEQ ID NO: 733966 - DNA, 25 bp, Artificial sequence
  Synthetic oligonucleotide
ccccggacggcccgtccgagcgcgc

SEQ ID NO: 733967 - DNA, 25 bp, Artificial sequence
  Synthetic oligonucleotide
ggcgccatcgcgcgagcgggcgggc

SEQ ID NO: 733968 - DNA, 25 bp, Artificial sequence
  Synthetic oligonucleotide
ggcggcacgtcccacgcggcgcccc

SEQ ID NO: 733969 - DNA, 25 bp, Artificial sequence
  Synthetic oligonucleotide
ggcggcacgtccgacgcggcgcccc

SEQ ID NO: 733970 - DNA, 25 bp, Artificial sequence
  Synthetic oligonucleotide
cggcccacggtccaccgcgggccgc

SEQ ID NO: 733971 - DNA, 25 bp, Artificial sequence
  Synthetic oligonucleotide
cggcccacggtcgaccgcgggccgc

SEQ ID NO: 733972 - DNA, 25 bp, Artificial sequence
  Synthetic oligonucleotide
cggccgacgcccgtcgcgaccgccg

SEQ ID NO: 733973 - DNA, 25 bp, Artificial sequence
  Synthetic oligonucleotide
ccccggacggccggtccgagcgcgc

SEQ ID NO: 733974 - DNA, 25 bp, Artificial sequence
  Synthetic oligonucleotide
ccccgcacccggggtagcggcgcgc

SEQ ID NO: 733975 - DNA, 25 bp, Artificial sequence
  Synthetic oligonucleotide
ggcgggacgcggacgtccggcccgc

SEQ ID NO: 733976 - DNA, 25 bp, Artificial sequence
  Synthetic oligonucleotide
ggcgggacgcggtcgtccggcccgc

SEQ ID NO: 733977 - DNA, 25 bp, Artificial sequence
  Synthetic oligonucleotide
cgggccacgcgggcgtacgcgccgc

SEQ ID NO: 733978 - DNA, 25 bp, Artificial sequence
  Synthetic oligonucleotide
cgggccacgcggccgtacgcgccgc

SEQ ID NO: 733979 - DNA, 25 bp, Artificial sequence
  Synthetic oligonucleotide
cggcccacgcgcccggttgcgggcc

SEQ ID NO: 733980 - DNA, 25 bp, Artificial sequence
  Synthetic oligonucleotide
ggggcgaccgtccctccgcgcgcgg

SEQ ID NO: 733981 - DNA, 25 bp, Artificial sequence
  Synthetic oligonucleotide
ggggcgaccgtcgctccgcgcgcgg

SEQ ID NO: 733982 - DNA, 25 bp, Artificial sequence
  Synthetic oligonucleotide
gaaatcgattgaaatattatattgt

SEQ ID NO: 733983 - DNA, 25 bp, Artificial sequence
  Synthetic oligonucleotide
aattcaaatatgcggataattataa

SEQ ID NO: 733984 - DNA, 25 bp, Artificial sequence
  Synthetic oligonucleotide
gaaatcgattgatatattatattgt

SEQ ID NO: 733985 - DNA, 25 bp, Artificial sequence
  Synthetic oligonucleotide
aatctcgattattaatgtacaatat

SEQ ID NO: 733986 - DNA, 25 bp, Artificial sequence
  Synthetic oligonucleotide
ttgttttccgaatatttataaaatc

SEQ ID NO: 733987 - DNA, 25 bp, Artificial sequence
  Synthetic oligonucleotide
aattcaaatatggggataattataa

SEQ ID NO: 733988 - DNA, 25 bp, Artificial sequence
  Synthetic oligonucleotide
actgatcgattatataatgataaat

SEQ ID NO: 733989 - DNA, 25 bp, Artificial sequence
  Synthetic oligonucleotide
actgatcgattaaataatgataaat

SEQ ID NO: 733990 - DNA, 25 bp, Artificial sequence
  Synthetic oligonucleotide
ttaatcgttaatttacaatttctag

SEQ ID NO: 733991 - DNA, 25 bp, Artificial sequence
  Synthetic oligonucleotide
ttaatcgttaatatacaatttctag

SEQ ID NO: 733992 - DNA, 25 bp, Artificial sequence
  Synthetic oligonucleotide
tacattaacgtatatattcgataat

SEQ ID NO: 733993 - DNA, 25 bp, Artificial sequence
  Synthetic oligonucleotide
aatctcgattataaatgtacaatat

SEQ ID NO: 733994 - DNA, 25 bp, Artificial sequence
  Synthetic oligonucleotide
atatatgatattataatcggatgaa

SEQ ID NO: 733995 - DNA, 25 bp, Artificial sequence
  Synthetic oligonucleotide
tataatattattcgataagaagcaa

SEQ ID NO: 733996 - DNA, 25 bp, Artificial sequence
  Synthetic oligonucleotide
tataatattattggataagaagcaa

SEQ ID NO: 733997 - DNA, 25 bp, Artificial sequence
  Synthetic oligonucleotide
taatgatcggataatttaattacaa

SEQ ID NO: 733998 - DNA, 25 bp, Artificial sequence
  Synthetic oligonucleotide
taatgatcggattatttaattacaa

SEQ ID NO: 733999 - DNA, 25 bp, Artificial sequence
  Synthetic oligonucleotide
attactatttgacgattaattatct

SEQ ID NO: 734000 - DNA, 25 bp, Artificial sequence
  Synthetic oligonucleotide
tacattaacgtaaatattcgataat

SEQ ID NO: 734001 - DNA, 25 bp, Artificial sequence
  Synthetic oligonucleotide
aatagttataactttaacgattcaa

SEQ ID NO: 734002 - DNA, 25 bp, Artificial sequence
  Synthetic oligonucleotide
taattgacgttattataatacagtt

SEQ ID NO: 734003 - DNA, 25 bp, Artificial sequence
  Synthetic oligonucleotide
taattgacgttaatataatacagtt

SEQ ID NO: 734004 - DNA, 25 bp, Artificial sequence
  Synthetic oligonucleotide
attaattatctacattgcgaatttt

SEQ ID NO: 734005 - DNA, 25 bp, Artificial sequence
  Synthetic oligonucleotide
attaattatctagattgcgaatttt

SEQ ID NO: 734006 - DNA, 25 bp, Artificial sequence
  Synthetic oligonucleotide
cttattcgtaactagataaatatat

SEQ ID NO: 734007 - DNA, 25 bp, Artificial sequence
  Synthetic oligonucleotide
tttatctatttattgcgaataagta

SEQ ID NO: 734008 - DNA, 25 bp, Artificial sequence
  Synthetic oligonucleotide
atatatgatattttaatcggatgaa

SEQ ID NO: 734009 - DNA, 25 bp, Artificial sequence
  Synthetic oligonucleotide
aaaaactaacgattcgatattaata

SEQ ID NO: 734010 - DNA, 25 bp, Artificial sequence
  Synthetic oligonucleotide
attgttatttaccagattaatgatt

SEQ ID NO: 734011 - DNA, 25 bp, Artificial sequence
  Synthetic oligonucleotide
attgttatttacgagattaatgatt

SEQ ID NO: 734012 - DNA, 25 bp, Artificial sequence
  Synthetic oligonucleotide
tattcttcgaatataagttagataa

SEQ ID NO: 734013 - DNA, 25 bp, Artificial sequence
  Synthetic oligonucleotide
tattcttcgaatttaagttagataa

SEQ ID NO: 734014 - DNA, 25 bp, Artificial sequence
  Synthetic oligonucleotide
atttttcgtctaagttatatagaaa

SEQ ID NO: 734015 - DNA, 25 bp, Artificial sequence
  Synthetic oligonucleotide
atttttcgtctatgttatatagaaa

SEQ ID NO: 734016 - DNA, 25 bp, Artificial sequence
  Synthetic oligonucleotide
ttgttttccgaaaatttataaaatc

SEQ ID NO: 734017 - DNA, 25 bp, Artificial sequence
  Synthetic oligonucleotide
aatagttataacattaacgattcaa

SEQ ID NO: 734018 - DNA, 25 bp, Artificial sequence
  Synthetic oligonucleotide
tttatctatttaatgcgaataagta

SEQ ID NO: 734019 - DNA, 25 bp, Artificial sequence
  Synthetic oligonucleotide
tatattaattaaatcgtatcaggta

SEQ ID NO: 734020 - DNA, 25 bp, Artificial sequence
  Synthetic oligonucleotide
tatattaattaattcgtatcaggta

SEQ ID NO: 734021 - DNA, 25 bp, Artificial sequence
  Synthetic oligonucleotide
aaaaactaacgaatcgatattaata

SEQ ID NO: 734022 - DNA, 25 bp, Artificial sequence
  Synthetic oligonucleotide
cttattcgtaacaagataaatatat

SEQ ID NO: 734023 - DNA, 25 bp, Artificial sequence
  Synthetic oligonucleotide
atgataatttaacttatcgataaca

SEQ ID NO: 734024 - DNA, 25 bp, Artificial sequence
  Synthetic oligonucleotide
ataatcgaattatattaagtaccta

SEQ ID NO: 734025 - DNA, 25 bp, Artificial sequence
  Synthetic oligonucleotide
ataatcgaattaaattaagtaccta

SEQ ID NO: 734026 - DNA, 25 bp, Artificial sequence
  Synthetic oligonucleotide
acaaatttgatcctaaatatctaat

SEQ ID NO: 734027 - DNA, 25 bp, Artificial sequence
  Synthetic oligonucleotide
acaaatttgatcgtaaatatctaat

SEQ ID NO: 734028 - DNA, 25 bp, Artificial sequence
  Synthetic oligonucleotide
caaactagtttattcgttattatat

SEQ ID NO: 734029 - DNA, 25 bp, Artificial sequence
  Synthetic oligonucleotide
caaactagtttaatcgttattatat

SEQ ID NO: 734030 - DNA, 25 bp, Artificial sequence
  Synthetic oligonucleotide
atttatttgatttcgacaattgttt

SEQ ID NO: 734031 - DNA, 25 bp, Artificial sequence
  Synthetic oligonucleotide
gttaaataccgaaataatattgaat

SEQ ID NO: 734032 - DNA, 25 bp, Artificial sequence
  Synthetic oligonucleotide
atgataatttaagttatcgataaca

SEQ ID NO: 734033 - DNA, 25 bp, Artificial sequence
  Synthetic oligonucleotide
tcaattagttgtacgtataattata

SEQ ID NO: 734034 - DNA, 25 bp, Artificial sequence
  Synthetic oligonucleotide
gatattagtttaacgatattacata

SEQ ID NO: 734035 - DNA, 25 bp, Artificial sequence
  Synthetic oligonucleotide
gatattagtttatcgatattacata

SEQ ID NO: 734036 - DNA, 25 bp, Artificial sequence
  Synthetic oligonucleotide
tttttttacgattacgatttataga

SEQ ID NO: 734037 - DNA, 25 bp, Artificial sequence
  Synthetic oligonucleotide
tttttttacgataacgatttataga

SEQ ID NO: 734038 - DNA, 25 bp, Artificial sequence
  Synthetic oligonucleotide
atctattcgataaaatgtaattctt

SEQ ID NO: 734039 - DNA, 25 bp, Artificial sequence
  Synthetic oligonucleotide
aaacttttagcgttattatgttata

SEQ ID NO: 734040 - DNA, 25 bp, Artificial sequence
  Synthetic oligonucleotide
gtaattgataattatacgataacaa

SEQ ID NO: 734041 - DNA, 25 bp, Artificial sequence
  Synthetic oligonucleotide
gtaattgataataatacgataacaa

SEQ ID NO: 734042 - DNA, 25 bp, Artificial sequence
  Synthetic oligonucleotide
atttatttgattacgacaattgttt

SEQ ID NO: 734043 - DNA, 25 bp, Artificial sequence
  Synthetic oligonucleotide
atactattatataacgaaacgtaaa

SEQ ID NO: 734044 - DNA, 25 bp, Artificial sequence
  Synthetic oligonucleotide
attagatttaacacgtaatacattt

SEQ ID NO: 734045 - DNA, 25 bp, Artificial sequence
  Synthetic oligonucleotide
atgagaagatataatcgtatttatt

SEQ ID NO: 734046 - DNA, 25 bp, Artificial sequence
  Synthetic oligonucleotide
atgagaagatattatcgtatttatt

SEQ ID NO: 734047 - DNA, 25 bp, Artificial sequence
  Synthetic oligonucleotide
atatatattaagtaattcgtcaatg

SEQ ID NO: 734048 - DNA, 25 bp, Artificial sequence
  Synthetic oligonucleotide
atatatattaagaaattcgtcaatg

SEQ ID NO: 734049 - DNA, 25 bp, Artificial sequence
  Synthetic oligonucleotide
tatttacgaactttataattggaat

SEQ ID NO: 734050 - DNA, 25 bp, Artificial sequence
  Synthetic oligonucleotide
tatttacgaactatataattggaat

SEQ ID NO: 734051 - DNA, 25 bp, Artificial sequence
  Synthetic oligonucleotide
caatctactcgttttaattaaattt

SEQ ID NO: 734052 - DNA, 25 bp, Artificial sequence
  Synthetic oligonucleotide
atagagattaaccatattatatgta

SEQ ID NO: 734053 - DNA, 25 bp, Artificial sequence
  Synthetic oligonucleotide
atactattatattacgaaacgtaaa

SEQ ID NO: 734054 - DNA, 25 bp, Artificial sequence
  Synthetic oligonucleotide
atagagattaacgatattatatgta

SEQ ID NO: 734055 - DNA, 25 bp, Artificial sequence
  Synthetic oligonucleotide
ctaatattataccaattactatcat

SEQ ID NO: 734056 - DNA, 25 bp, Artificial sequence
  Synthetic oligonucleotide
ctaatattatacgaattactatcat

SEQ ID NO: 734057 - DNA, 25 bp, Artificial sequence
  Synthetic oligonucleotide
taaaagattcgcaaatataattgat

SEQ ID NO: 734058 - DNA, 25 bp, Artificial sequence
  Synthetic oligonucleotide
taaaagattcgctaatataattgat

SEQ ID NO: 734059 - DNA, 25 bp, Artificial sequence
  Synthetic oligonucleotide
gttaaataccgatataatattgaat

SEQ ID NO: 734060 - DNA, 25 bp, Artificial sequence
  Synthetic oligonucleotide
attactatttgaggattaattatct

SEQ ID NO: 734061 - DNA, 25 bp, Artificial sequence
  Synthetic oligonucleotide
tcaattagttgttcgtataattata

SEQ ID NO: 734062 - DNA, 25 bp, Artificial sequence
  Synthetic oligonucleotide
attagatttaactcgtaatacattt

SEQ ID NO: 734063 - DNA, 25 bp, Artificial sequence
  Synthetic oligonucleotide
aaaactaacgataagcataataaat

SEQ ID NO: 734064 - DNA, 25 bp, Artificial sequence
  Synthetic oligonucleotide
tacatcgaatatataatctatgaaa

SEQ ID NO: 734065 - DNA, 25 bp, Artificial sequence
  Synthetic oligonucleotide
aatatattagtatttcgtaaagcaa

SEQ ID NO: 734066 - DNA, 25 bp, Artificial sequence
  Synthetic oligonucleotide
aatacaactcgtaataatatttgaa

SEQ ID NO: 734067 - DNA, 25 bp, Artificial sequence
  Synthetic oligonucleotide
gtaaatatactaactattcgttaat

SEQ ID NO: 734068 - DNA, 25 bp, Artificial sequence
  Synthetic oligonucleotide
gtaaatatactatctattcgttaat

SEQ ID NO: 734069 - DNA, 25 bp, Artificial sequence
  Synthetic oligonucleotide
taaataactatcgataattatgctt

SEQ ID NO: 734070 - DNA, 25 bp, Artificial sequence
  Synthetic oligonucleotide
taaataactatccataattatgctt

SEQ ID NO: 734071 - DNA, 25 bp, Artificial sequence
  Synthetic oligonucleotide
atgtattcggattgattatatatta

SEQ ID NO: 734072 - DNA, 25 bp, Artificial sequence
  Synthetic oligonucleotide
atgtattcggatagattatatatta

SEQ ID NO: 734073 - DNA, 25 bp, Artificial sequence
  Synthetic oligonucleotide
attgaataaatcgatatagttctat

SEQ ID NO: 734074 - DNA, 25 bp, Artificial sequence
  Synthetic oligonucleotide
aagtatattattttccgatatctat

SEQ ID NO: 734075 - DNA, 25 bp, Artificial sequence
  Synthetic oligonucleotide
aaacttttagcgatattatgttata

SEQ ID NO: 734076 - DNA, 25 bp, Artificial sequence
  Synthetic oligonucleotide
aagtatattattatccgatatctat

SEQ ID NO: 734077 - DNA, 25 bp, Artificial sequence
  Synthetic oligonucleotide
acacaattagataattacgttattt

SEQ ID NO: 734078 - DNA, 25 bp, Artificial sequence
  Synthetic oligonucleotide
acacaattagattattacgttattt

SEQ ID NO: 734079 - DNA, 25 bp, Artificial sequence
  Synthetic oligonucleotide
agtaaaacgctatattaataatcaa

SEQ ID NO: 734080 - DNA, 25 bp, Artificial sequence
  Synthetic oligonucleotide
agtaaaacgctaaattaataatcaa

SEQ ID NO: 734081 - DNA, 25 bp, Artificial sequence
  Synthetic oligonucleotide
caatctcgatttatatatcttttat

SEQ ID NO: 734082 - DNA, 25 bp, Artificial sequence
  Synthetic oligonucleotide
caatctcgatttttatatcttttat

SEQ ID NO: 734083 - DNA, 25 bp, Artificial sequence
  Synthetic oligonucleotide
atgtagtcgatttataatagtttta

SEQ ID NO: 734084 - DNA, 25 bp, Artificial sequence
  Synthetic oligonucleotide
atgtagtcgattaataatagtttta

SEQ ID NO: 734085 - DNA, 25 bp, Artificial sequence
  Synthetic oligonucleotide
tatattcgagttaagttaatttgaa

SEQ ID NO: 734086 - DNA, 25 bp, Artificial sequence
  Synthetic oligonucleotide
tacatcgaatatttaatctatgaaa

SEQ ID NO: 734087 - DNA, 25 bp, Artificial sequence
  Synthetic oligonucleotide
attgaataaatccatatagttctat

SEQ ID NO: 734088 - DNA, 25 bp, Artificial sequence
  Synthetic oligonucleotide
agtttatatcgtaaatctaaaaaga

SEQ ID NO: 734089 - DNA, 25 bp, Artificial sequence
  Synthetic oligonucleotide
aaaactaacgattagcataataaat

SEQ ID NO: 734090 - DNA, 25 bp, Artificial sequence
  Synthetic oligonucleotide
ttaggtcgacaatattataatttat

SEQ ID NO: 734091 - DNA, 25 bp, Artificial sequence
  Synthetic oligonucleotide
ttattaatatgtgttatcgttatgt

SEQ ID NO: 734092 - DNA, 25 bp, Artificial sequence
  Synthetic oligonucleotide
ttattaatatgtcttatcgttatgt

SEQ ID NO: 734093 - DNA, 25 bp, Artificial sequence
  Synthetic oligonucleotide
tatacattatctaatcgttagtaat

SEQ ID NO: 734094 - DNA, 25 bp, Artificial sequence
  Synthetic oligonucleotide
tatacattatcttatcgttagtaat

SEQ ID NO: 734095 - DNA, 25 bp, Artificial sequence
  Synthetic oligonucleotide
catttttgtaatattcgataatcta

SEQ ID NO: 734096 - DNA, 25 bp, Artificial sequence
  Synthetic oligonucleotide
catttttgtaattttcgataatcta

SEQ ID NO: 734097 - DNA, 25 bp, Artificial sequence
  Synthetic oligonucleotide
ataaatatcgtacatgttatatgta

SEQ ID NO: 734098 - DNA, 25 bp, Artificial sequence
  Synthetic oligonucleotide
aatacaactcgttataatatttgaa

SEQ ID NO: 734099 - DNA, 25 bp, Artificial sequence
  Synthetic oligonucleotide
agtttatatcgttaatctaaaaaga

SEQ ID NO: 734100 - DNA, 25 bp, Artificial sequence
  Synthetic oligonucleotide
aatatattagtaattcgtaaagcaa

SEQ ID NO: 734101 - DNA, 25 bp, Artificial sequence
  Synthetic oligonucleotide
aattttgataagacgttaaacatat

SEQ ID NO: 734102 - DNA, 25 bp, Artificial sequence
  Synthetic oligonucleotide
aattttgataagtcgttaaacatat

SEQ ID NO: 734103 - DNA, 25 bp, Artificial sequence
  Synthetic oligonucleotide
ttaatcgtattgtattaactaaaag

SEQ ID NO: 734104 - DNA, 25 bp, Artificial sequence
  Synthetic oligonucleotide
ttaatcgtattgaattaactaaaag

SEQ ID NO: 734105 - DNA, 25 bp, Artificial sequence
  Synthetic oligonucleotide
aaatattagtcgaaatttatgatct

SEQ ID NO: 734106 - DNA, 25 bp, Artificial sequence
  Synthetic oligonucleotide
aaatattagtcgtaatttatgatct

SEQ ID NO: 734107 - DNA, 25 bp, Artificial sequence
  Synthetic oligonucleotide
gaattataaatttactatcgtctat

SEQ ID NO: 734108 - DNA, 25 bp, Artificial sequence
  Synthetic oligonucleotide
gaattataaattaactatcgtctat

SEQ ID NO: 734109 - DNA, 25 bp, Artificial sequence
  Synthetic oligonucleotide
aaatcaattcgactatattatagaa

SEQ ID NO: 734110 - DNA, 25 bp, Artificial sequence
  Synthetic oligonucleotide
aaatcaattcgagtatattatagaa

SEQ ID NO: 734111 - DNA, 25 bp, Artificial sequence
  Synthetic oligonucleotide
ataaatatcgtagatgttatatgta

SEQ ID NO: 734112 - DNA, 25 bp, Artificial sequence
  Synthetic oligonucleotide
ttgatgtattaccgttaaataaatt

SEQ ID NO: 734113 - DNA, 25 bp, Artificial sequence
  Synthetic oligonucleotide
tatattcgagtttagttaatttgaa

SEQ ID NO: 734114 - DNA, 25 bp, Artificial sequence
  Synthetic oligonucleotide
ttataatatcgtatttaaccgatat

SEQ ID NO: 734115 - DNA, 25 bp, Artificial sequence
  Synthetic oligonucleotide
taaaagatacgattattgtaactaa

SEQ ID NO: 734116 - DNA, 25 bp, Artificial sequence
  Synthetic oligonucleotide
taaaagatacgaatattgtaactaa

SEQ ID NO: 734117 - DNA, 25 bp, Artificial sequence
  Synthetic oligonucleotide
gataattattaccaatcatttaaga

SEQ ID NO: 734118 - DNA, 25 bp, Artificial sequence
  Synthetic oligonucleotide
gataattattacgaatcatttaaga

SEQ ID NO: 734119 - DNA, 25 bp, Artificial sequence
  Synthetic oligonucleotide
aacattacgattctaaattatttca

SEQ ID NO: 734120 - DNA, 25 bp, Artificial sequence
  Synthetic oligonucleotide
aacattacgattgtaaattatttca

SEQ ID NO: 734121 - DNA, 25 bp, Artificial sequence
  Synthetic oligonucleotide
cttttatcaaatacgtctattaatt

SEQ ID NO: 734122 - DNA, 25 bp, Artificial sequence
  Synthetic oligonucleotide
gaattatttcgtataattactcata

SEQ ID NO: 734123 - DNA, 25 bp, Artificial sequence
  Synthetic oligonucleotide
ttgatgtattacggttaaataaatt

SEQ ID NO: 734124 - DNA, 25 bp, Artificial sequence
  Synthetic oligonucleotide
gaattatttcgtttaattactcata

SEQ ID NO: 734125 - DNA, 25 bp, Artificial sequence
  Synthetic oligonucleotide
ttagtattaattacgaacaatctaa

SEQ ID NO: 734126 - DNA, 25 bp, Artificial sequence
  Synthetic oligonucleotide
ttagtattaatttcgaacaatctaa

SEQ ID NO: 734127 - DNA, 25 bp, Artificial sequence
  Synthetic oligonucleotide
atagatatatctatcgataaaaaca

SEQ ID NO: 734128 - DNA, 25 bp, Artificial sequence
  Synthetic oligonucleotide
atagatatatctttcgataaaaaca

SEQ ID NO: 734129 - DNA, 25 bp, Artificial sequence
  Synthetic oligonucleotide
gtaactatatcgtattacaaatatt

SEQ ID NO: 734130 - DNA, 25 bp, Artificial sequence
  Synthetic oligonucleotide
gtaactatatcgaattacaaatatt

SEQ ID NO: 734131 - DNA, 25 bp, Artificial sequence
  Synthetic oligonucleotide
taatgactattaggttaatttcata

SEQ ID NO: 734132 - DNA, 25 bp, Artificial sequence
  Synthetic oligonucleotide
taatgactattacgttaatttcata

SEQ ID NO: 734133 - DNA, 25 bp, Artificial sequence
  Synthetic oligonucleotide
ataggacgatatcaataaatataat

SEQ ID NO: 734134 - DNA, 25 bp, Artificial sequence
  Synthetic oligonucleotide
ataggacgatatgaataaatataat

SEQ ID NO: 734135 - DNA, 25 bp, Artificial sequence
  Synthetic oligonucleotide
cttttatcaaattcgtctattaatt

SEQ ID NO: 734136 - DNA, 25 bp, Artificial sequence
  Synthetic oligonucleotide
tatattattatacgcgaaaatctaa

SEQ ID NO: 734137 - DNA, 25 bp, Artificial sequence
  Synthetic oligonucleotide
tatctgatacattattcgtatatta

SEQ ID NO: 734138 - DNA, 25 bp, Artificial sequence
  Synthetic oligonucleotide
tatctgatacataattcgtatatta

SEQ ID NO: 734139 - DNA, 25 bp, Artificial sequence
  Synthetic oligonucleotide
tatctatacttattcgtaatactaa

SEQ ID NO: 734140 - DNA, 25 bp, Artificial sequence
  Synthetic oligonucleotide
tatctatacttaatcgtaatactaa

SEQ ID NO: 734141 - DNA, 25 bp, Artificial sequence
  Synthetic oligonucleotide
aatgtattaagtacgattaacaatt

SEQ ID NO: 734142 - DNA, 25 bp, Artificial sequence
  Synthetic oligonucleotide
aatgtattaagttcgattaacaatt

SEQ ID NO: 734143 - DNA, 25 bp, Artificial sequence
  Synthetic oligonucleotide
tatagattagatatcgatatattct

SEQ ID NO: 734144 - DNA, 25 bp, Artificial sequence
  Synthetic oligonucleotide
tatagattagatttcgatatattct

SEQ ID NO: 734145 - DNA, 25 bp, Artificial sequence
  Synthetic oligonucleotide
catttttaatataatcgttctaaac

SEQ ID NO: 734146 - DNA, 25 bp, Artificial sequence
  Synthetic oligonucleotide
ttataatatcgtttttaaccgatat

SEQ ID NO: 734147 - DNA, 25 bp, Artificial sequence
  Synthetic oligonucleotide
tatattattataggcgaaaatctaa

SEQ ID NO: 734148 - DNA, 25 bp, Artificial sequence
  Synthetic oligonucleotide
atctattcgatataatgtaattctt

SEQ ID NO: 734149 - DNA, 25 bp, Artificial sequence
  Synthetic oligonucleotide
attatacggttattttaatagaaca

SEQ ID NO: 734150 - DNA, 25 bp, Artificial sequence
  Synthetic oligonucleotide
attatacggttaatttaatagaaca

SEQ ID NO: 734151 - DNA, 25 bp, Artificial sequence
  Synthetic oligonucleotide
aataatttatatgaatcgcttagaa

SEQ ID NO: 734152 - DNA, 25 bp, Artificial sequence
  Synthetic oligonucleotide
aataatttatatcaatcgcttagaa

SEQ ID NO: 734153 - DNA, 25 bp, Artificial sequence
  Synthetic oligonucleotide
tgtaatttacgaaaatatcttaaac

SEQ ID NO: 734154 - DNA, 25 bp, Artificial sequence
  Synthetic oligonucleotide
tgtaatttacgataatatcttaaac

SEQ ID NO: 734155 - DNA, 25 bp, Artificial sequence
  Synthetic oligonucleotide
tgatttatatccgttaattaatatg

SEQ ID NO: 734156 - DNA, 25 bp, Artificial sequence
  Synthetic oligonucleotide
tgatttatatcccttaattaatatg

SEQ ID NO: 734157 - DNA, 25 bp, Artificial sequence
  Synthetic oligonucleotide
aagtgtaacaataaatcgatattat

SEQ ID NO: 734158 - DNA, 25 bp, Artificial sequence
  Synthetic oligonucleotide
aagtgtaacaattaatcgatattat

SEQ ID NO: 734159 - DNA, 25 bp, Artificial sequence
  Synthetic oligonucleotide
catttttaatattatcgttctaaac

SEQ ID NO: 734160 - DNA, 25 bp, Artificial sequence
  Synthetic oligonucleotide
aatctttttatttgttcgaaataca

SEQ ID NO: 734161 - DNA, 25 bp, Artificial sequence
  Synthetic oligonucleotide
tttatttgtattaaatcgatttgca

SEQ ID NO: 734162 - DNA, 25 bp, Artificial sequence
  Synthetic oligonucleotide
ttatatcaaattggtaattatcaac

SEQ ID NO: 734163 - DNA, 25 bp, Artificial sequence
  Synthetic oligonucleotide
tttttgataatgcgcaataatattt

SEQ ID NO: 734164 - DNA, 25 bp, Artificial sequence
  Synthetic oligonucleotide
tttttgataatgggcaataatattt

SEQ ID NO: 734165 - DNA, 25 bp, Artificial sequence
  Synthetic oligonucleotide
taaagtaatatttcgaagattaatc

SEQ ID NO: 734166 - DNA, 25 bp, Artificial sequence
  Synthetic oligonucleotide
taaagtaatattacgaagattaatc

SEQ ID NO: 734167 - DNA, 25 bp, Artificial sequence
  Synthetic oligonucleotide
aaatcatgatattaatcgaagtaaa

SEQ ID NO: 734168 - DNA, 25 bp, Artificial sequence
  Synthetic oligonucleotide
aaatcatgatataaatcgaagtaaa

SEQ ID NO: 734169 - DNA, 25 bp, Artificial sequence
  Synthetic oligonucleotide
atagttctaatgcgataatatttta

SEQ ID NO: 734170 - DNA, 25 bp, Artificial sequence
  Synthetic oligonucleotide
atagttctaatgggataatatttta

SEQ ID NO: 734171 - DNA, 25 bp, Artificial sequence
  Synthetic oligonucleotide
acagttacttaccaattatattatt

SEQ ID NO: 734172 - DNA, 25 bp, Artificial sequence
  Synthetic oligonucleotide
gtattattagtttattacgattgat

SEQ ID NO: 734173 - DNA, 25 bp, Artificial sequence
  Synthetic oligonucleotide
aatctttttattagttcgaaataca

SEQ ID NO: 734174 - DNA, 25 bp, Artificial sequence
  Synthetic oligonucleotide
gtattattagttaattacgattgat

SEQ ID NO: 734175 - DNA, 25 bp, Artificial sequence
  Synthetic oligonucleotide
gagatatcgtttagtattaattaat

SEQ ID NO: 734176 - DNA, 25 bp, Artificial sequence
  Synthetic oligonucleotide
gagatatcgttttgtattaattaat

SEQ ID NO: 734177 - DNA, 25 bp, Artificial sequence
  Synthetic oligonucleotide
tgaattcttatcgtatattatactt

SEQ ID NO: 734178 - DNA, 25 bp, Artificial sequence
  Synthetic oligonucleotide
tgaattcttatcctatattatactt

SEQ ID NO: 734179 - DNA, 25 bp, Artificial sequence
  Synthetic oligonucleotide
actagaactatccaaattatttatt

SEQ ID NO: 734180 - DNA, 25 bp, Artificial sequence
  Synthetic oligonucleotide
actagaactatcgaaattatttatt

SEQ ID NO: 734181 - DNA, 25 bp, Artificial sequence
  Synthetic oligonucleotide
tttcttatacgaatcataatttact

SEQ ID NO: 734182 - DNA, 25 bp, Artificial sequence
  Synthetic oligonucleotide
tttcttatacgattcataatttact

SEQ ID NO: 734183 - DNA, 25 bp, Artificial sequence
  Synthetic oligonucleotide
gttcatattaataagtacgataaat

SEQ ID NO: 734184 - DNA, 25 bp, Artificial sequence
  Synthetic oligonucleotide
gttcatattaattagtacgataaat

SEQ ID NO: 734185 - DNA, 25 bp, Artificial sequence
  Synthetic oligonucleotide
taatagataaccctatcatttttat

SEQ ID NO: 734186 - DNA, 25 bp, Artificial sequence
  Synthetic oligonucleotide
atatattatcgaaaatcaatacgta

SEQ ID NO: 734187 - DNA, 25 bp, Artificial sequence
  Synthetic oligonucleotide
acagttacttacgaattatattatt

SEQ ID NO: 734188 - DNA, 25 bp, Artificial sequence
  Synthetic oligonucleotide
aaatttcgtactagttatatcaaaa

SEQ ID NO: 734189 - DNA, 25 bp, Artificial sequence
  Synthetic oligonucleotide
gtgttatacgattactatattaatt

SEQ ID NO: 734190 - DNA, 25 bp, Artificial sequence
  Synthetic oligonucleotide
gtgttatacgataactatattaatt

SEQ ID NO: 734191 - DNA, 25 bp, Artificial sequence
  Synthetic oligonucleotide
ttcatgtttattagtcgaattttat

SEQ ID NO: 734192 - DNA, 25 bp, Artificial sequence
  Synthetic oligonucleotide
ttcatgtttatttgtcgaattttat

SEQ ID NO: 734193 - DNA, 25 bp, Artificial sequence
  Synthetic oligonucleotide
aatttctatagacgttataatcata

SEQ ID NO: 734194 - DNA, 25 bp, Artificial sequence
  Synthetic oligonucleotide
aatttctatagaggttataatcata

SEQ ID NO: 734195 - DNA, 25 bp, Artificial sequence
  Synthetic oligonucleotide
aaaatatcgagtataaatacaaatc

SEQ ID NO: 734196 - DNA, 25 bp, Artificial sequence
  Synthetic oligonucleotide
aaaatatcgagtttaaatacaaatc

SEQ ID NO: 734197 - DNA, 25 bp, Artificial sequence
  Synthetic oligonucleotide
tattacgaaacttatagatacaata

SEQ ID NO: 734198 - DNA, 25 bp, Artificial sequence
  Synthetic oligonucleotide
tattacgaaactaatagatacaata

SEQ ID NO: 734199 - DNA, 25 bp, Artificial sequence
  Synthetic oligonucleotide
acacttacttatatcgattatttta

SEQ ID NO: 734200 - DNA, 25 bp, Artificial sequence
  Synthetic oligonucleotide
ttatatcaaattcgtaattatcaac

SEQ ID NO: 734201 - DNA, 25 bp, Artificial sequence
  Synthetic oligonucleotide
aaatttcgtacttgttatatcaaaa

SEQ ID NO: 734202 - DNA, 25 bp, Artificial sequence
  Synthetic oligonucleotide
tttatttgtatttaatcgatttgca

SEQ ID NO: 734203 - DNA, 25 bp, Artificial sequence
  Synthetic oligonucleotide
ttaattataaagaaattcgcattct

SEQ ID NO: 734204 - DNA, 25 bp, Artificial sequence
  Synthetic oligonucleotide
ttaattataaagtaattcgcattct

SEQ ID NO: 734205 - DNA, 25 bp, Artificial sequence
  Synthetic oligonucleotide
tgtatatcgaataaacattactaaa

SEQ ID NO: 734206 - DNA, 25 bp, Artificial sequence
  Synthetic oligonucleotide
tgtatatcgaattaacattactaaa

SEQ ID NO: 734207 - DNA, 25 bp, Artificial sequence
  Synthetic oligonucleotide
aatagttagtataattcgattaatg

SEQ ID NO: 734208 - DNA, 25 bp, Artificial sequence
  Synthetic oligonucleotide
aatagttagtattattcgattaatg

SEQ ID NO: 734209 - DNA, 25 bp, Artificial sequence
  Synthetic oligonucleotide
gaattatcgaaatttgatctttatt

SEQ ID NO: 734210 - DNA, 25 bp, Artificial sequence
  Synthetic oligonucleotide
gaattatcgaaaattgatctttatt

SEQ ID NO: 734211 - DNA, 25 bp, Artificial sequence
  Synthetic oligonucleotide
tcctataataagttcgaataatttt

SEQ ID NO: 734212 - DNA, 25 bp, Artificial sequence
  Synthetic oligonucleotide
tcctataataagatcgaataatttt

SEQ ID NO: 734213 - DNA, 25 bp, Artificial sequence
  Synthetic oligonucleotide
ttaatgttaataaacaacgtttagt

SEQ ID NO: 734214 - DNA, 25 bp, Artificial sequence
  Synthetic oligonucleotide
ttaatgttaatatacaacgtttagt

SEQ ID NO: 734215 - DNA, 25 bp, Artificial sequence
  Synthetic oligonucleotide
acacttacttatttcgattatttta

SEQ ID NO: 734216 - DNA, 25 bp, Artificial sequence
  Synthetic oligonucleotide
aaatcattaatgaatttcgttaaag

SEQ ID NO: 734217 - DNA, 25 bp, Artificial sequence
  Synthetic oligonucleotide
taatagataaccgtatcatttttat

SEQ ID NO: 734218 - DNA, 25 bp, Artificial sequence
  Synthetic oligonucleotide
ttattcgatttagcatattaataag

SEQ ID NO: 734219 - DNA, 25 bp, Artificial sequence
  Synthetic oligonucleotide
ataattaacgaatcattgtagaaaa

SEQ ID NO: 734220 - DNA, 25 bp, Artificial sequence
  Synthetic oligonucleotide
ataattaacgaaacattgtagaaaa

SEQ ID NO: 734221 - DNA, 25 bp, Artificial sequence
  Synthetic oligonucleotide
agtatgatatacgtttaataactaa

SEQ ID NO: 734222 - DNA, 25 bp, Artificial sequence
  Synthetic oligonucleotide
agtatgatatacctttaataactaa

SEQ ID NO: 734223 - DNA, 25 bp, Artificial sequence
  Synthetic oligonucleotide
tatatttatttaccgaattatcatg

SEQ ID NO: 734224 - DNA, 25 bp, Artificial sequence
  Synthetic oligonucleotide
tatatttatttagcgaattatcatg

SEQ ID NO: 734225 - DNA, 25 bp, Artificial sequence
  Synthetic oligonucleotide
ataagatatacgtttagtttttgaa

SEQ ID NO: 734226 - DNA, 25 bp, Artificial sequence
  Synthetic oligonucleotide
ataagatatacgattagtttttgaa

SEQ ID NO: 734227 - DNA, 25 bp, Artificial sequence
  Synthetic oligonucleotide
ttaggtcgacaaaattataatttat

SEQ ID NO: 734228 - DNA, 25 bp, Artificial sequence
  Synthetic oligonucleotide
tagtatttcgtaatgattatgtaat

SEQ ID NO: 734229 - DNA, 25 bp, Artificial sequence
  Synthetic oligonucleotide
aaatcattaatgtatttcgttaaag

SEQ ID NO: 734230 - DNA, 25 bp, Artificial sequence
  Synthetic oligonucleotide
tagtatttcgtattgattatgtaat

SEQ ID NO: 734231 - DNA, 25 bp, Artificial sequence
  Synthetic oligonucleotide
ttggtgttatattacgataaaaaat

SEQ ID NO: 734232 - DNA, 25 bp, Artificial sequence
  Synthetic oligonucleotide
ttggtgttatataacgataaaaaat

SEQ ID NO: 734233 - DNA, 25 bp, Artificial sequence
  Synthetic oligonucleotide
tctaaaaactttatacgttcaatta

SEQ ID NO: 734234 - DNA, 25 bp, Artificial sequence
  Synthetic oligonucleotide
tctaaaaactttttacgttcaatta

SEQ ID NO: 734235 - DNA, 25 bp, Artificial sequence
  Synthetic oligonucleotide
gtacatcgtctaataattaaatatt

SEQ ID NO: 734236 - DNA, 25 bp, Artificial sequence
  Synthetic oligonucleotide
gtacatcgtctattaattaaatatt

SEQ ID NO: 734237 - DNA, 25 bp, Artificial sequence
  Synthetic oligonucleotide
attaaaagtcgataatctatacaat

SEQ ID NO: 734238 - DNA, 25 bp, Artificial sequence
  Synthetic oligonucleotide
attaaaagtcgaaaatctatacaat

SEQ ID NO: 734239 - DNA, 25 bp, Artificial sequence
  Synthetic oligonucleotide
aatacaaggatatatcgttataaat

SEQ ID NO: 734240 - DNA, 25 bp, Artificial sequence
  Synthetic oligonucleotide
aatacaaggataaatcgttataaat

SEQ ID NO: 734241 - DNA, 25 bp, Artificial sequence
  Synthetic oligonucleotide
tctcagtttataaaaatcgaattaa

SEQ ID NO: 734242 - DNA, 25 bp, Artificial sequence
  Synthetic oligonucleotide
tctcagtttatataaatcgaattaa

SEQ ID NO: 734243 - DNA, 25 bp, Artificial sequence
  Synthetic oligonucleotide
caatctactcgtattaattaaattt

SEQ ID NO: 734244 - DNA, 25 bp, Artificial sequence
  Synthetic oligonucleotide
atattcttaatccaaaaattccatt

SEQ ID NO: 734245 - DNA, 25 bp, Artificial sequence
  Synthetic oligonucleotide
atttaaatgattattcgctatatct

SEQ ID NO: 734246 - DNA, 25 bp, Artificial sequence
  Synthetic oligonucleotide
atttaaatgatttttcgctatatct

SEQ ID NO: 734247 - DNA, 25 bp, Artificial sequence
  Synthetic oligonucleotide
tttataattatcaatttcgaaaagg

SEQ ID NO: 734248 - DNA, 25 bp, Artificial sequence
  Synthetic oligonucleotide
tttataattatctatttcgaaaagg

SEQ ID NO: 734249 - DNA, 25 bp, Artificial sequence
  Synthetic oligonucleotide
tatcttaatcgaactaaatacattt

SEQ ID NO: 734250 - DNA, 25 bp, Artificial sequence
  Synthetic oligonucleotide
tatcttaatcgatctaaatacattt

SEQ ID NO: 734251 - DNA, 25 bp, Artificial sequence
  Synthetic oligonucleotide
gaaaataatattggttgatacataa

SEQ ID NO: 734252 - DNA, 25 bp, Artificial sequence
  Synthetic oligonucleotide
gaaaataatattcgttgatacataa

SEQ ID NO: 734253 - DNA, 25 bp, Artificial sequence
  Synthetic oligonucleotide
caatgattatatcgtactataaatt

SEQ ID NO: 734254 - DNA, 25 bp, Artificial sequence
  Synthetic oligonucleotide
caatgattatatggtactataaatt

SEQ ID NO: 734255 - DNA, 25 bp, Artificial sequence
  Synthetic oligonucleotide
tgtgtattctaatcgatatatataa

SEQ ID NO: 734256 - DNA, 25 bp, Artificial sequence
  Synthetic oligonucleotide
ttattcgatttaccatattaataag

SEQ ID NO: 734257 - DNA, 25 bp, Artificial sequence
  Synthetic oligonucleotide
atattcttaatcgaaaaattccatt

SEQ ID NO: 734258 - DNA, 25 bp, Artificial sequence
  Synthetic oligonucleotide
cttaattctcgaatcaattattaaa

SEQ ID NO: 734259 - DNA, 25 bp, Artificial sequence
  Synthetic oligonucleotide
aaaaagtgcgtaaaatattattaac

SEQ ID NO: 734260 - DNA, 25 bp, Artificial sequence
  Synthetic oligonucleotide
aaaaagtgcgtataatattattaac

SEQ ID NO: 734261 - DNA, 25 bp, Artificial sequence
  Synthetic oligonucleotide
cttaattctcgattcaattattaaa

SEQ ID NO: 734262 - DNA, 25 bp, Artificial sequence
  Synthetic oligonucleotide
aatgtctataaccaaaattctataa

SEQ ID NO: 734263 - DNA, 25 bp, Artificial sequence
  Synthetic oligonucleotide
aattaaattcgaaaagattttagac

SEQ ID NO: 734264 - DNA, 25 bp, Artificial sequence
  Synthetic oligonucleotide
aattaaattcgataagattttagac

SEQ ID NO: 734265 - DNA, 25 bp, Artificial sequence
  Synthetic oligonucleotide
tatttttatgtcgtcgtataatata

SEQ ID NO: 734266 - DNA, 25 bp, Artificial sequence
  Synthetic oligonucleotide
tatttttatgtcctcgtataatata

SEQ ID NO: 734267 - DNA, 25 bp, Artificial sequence
  Synthetic oligonucleotide
taataaagttatacgattaacaatg

SEQ ID NO: 734268 - DNA, 25 bp, Artificial sequence
  Synthetic oligonucleotide
taataaagttattcgattaacaatg

SEQ ID NO: 734269 - DNA, 25 bp, Artificial sequence
  Synthetic oligonucleotide
ttttaattagtaggaataatgcttt

SEQ ID NO: 734270 - DNA, 25 bp, Artificial sequence
  Synthetic oligonucleotide
ttttaattagtacgaataatgcttt

SEQ ID NO: 734271 - DNA, 25 bp, Artificial sequence
  Synthetic oligonucleotide
tgtgtattctaaacgatatatataa

SEQ ID NO: 734272 - DNA, 25 bp, Artificial sequence
  Synthetic oligonucleotide
aatttatatattcggattaatgaga

SEQ ID NO: 734273 - DNA, 25 bp, Artificial sequence
  Synthetic oligonucleotide
atgattttaatgattaatcgctatt

SEQ ID NO: 734274 - DNA, 25 bp, Artificial sequence
  Synthetic oligonucleotide
atgattttaatgtttaatcgctatt

SEQ ID NO: 734275 - DNA, 25 bp, Artificial sequence
  Synthetic oligonucleotide
ctaaattttcgattctaatataaga

SEQ ID NO: 734276 - DNA, 25 bp, Artificial sequence
  Synthetic oligonucleotide
ctaaattttcgaatctaatataaga

SEQ ID NO: 734277 - DNA, 25 bp, Artificial sequence
  Synthetic oligonucleotide
cactacatcgtaaatttataaattt

SEQ ID NO: 734278 - DNA, 25 bp, Artificial sequence
  Synthetic oligonucleotide
cactacatcgtatatttataaattt

SEQ ID NO: 734279 - DNA, 25 bp, Artificial sequence
  Synthetic oligonucleotide
taacaaatttttggataactaagat

SEQ ID NO: 734280 - DNA, 25 bp, Artificial sequence
  Synthetic oligonucleotide
taacaaatttttcgataactaagat

SEQ ID NO: 734281 - DNA, 25 bp, Artificial sequence
  Synthetic oligonucleotide
aattgtattatcggttagaatttta

SEQ ID NO: 734282 - DNA, 25 bp, Artificial sequence
  Synthetic oligonucleotide
aattgtattatccgttagaatttta

SEQ ID NO: 734283 - DNA, 25 bp, Artificial sequence
  Synthetic oligonucleotide
tattttaacgataaatatctgtaag

SEQ ID NO: 734284 - DNA, 25 bp, Artificial sequence
  Synthetic oligonucleotide
atgaatctaaaccatattaatattg

SEQ ID NO: 734285 - DNA, 25 bp, Artificial sequence
  Synthetic oligonucleotide
aatttatatattgggattaatgaga

SEQ ID NO: 734286 - DNA, 25 bp, Artificial sequence
  Synthetic oligonucleotide
atcattaacgatagttatatttgaa

SEQ ID NO: 734287 - DNA, 25 bp, Artificial sequence
  Synthetic oligonucleotide
aattttcttatctacgattatatag

SEQ ID NO: 734288 - DNA, 25 bp, Artificial sequence
  Synthetic oligonucleotide
aattttcttatcaacgattatatag

SEQ ID NO: 734289 - DNA, 25 bp, Artificial sequence
  Synthetic oligonucleotide
tagtaatttaaaacgttagaaacaa

SEQ ID NO: 734290 - DNA, 25 bp, Artificial sequence
  Synthetic oligonucleotide
tagtaatttaaatcgttagaaacaa

SEQ ID NO: 734291 - DNA, 25 bp, Artificial sequence
  Synthetic oligonucleotide
attgttactacgtaaattatgatat

SEQ ID NO: 734292 - DNA, 25 bp, Artificial sequence
  Synthetic oligonucleotide
attgttactacgaaaattatgatat

SEQ ID NO: 734293 - DNA, 25 bp, Artificial sequence
  Synthetic oligonucleotide
cattagcgattatttaatattgtaa

SEQ ID NO: 734294 - DNA, 25 bp, Artificial sequence
  Synthetic oligonucleotide
cattagcgattaattaatattgtaa

SEQ ID NO: 734295 - DNA, 25 bp, Artificial sequence
  Synthetic oligonucleotide
taaaccgatgttatattatatgata

SEQ ID NO: 734296 - DNA, 25 bp, Artificial sequence
  Synthetic oligonucleotide
taaaccgatgttttattatatgata

SEQ ID NO: 734297 - DNA, 25 bp, Artificial sequence
  Synthetic oligonucleotide
atgaatctaaacgatattaatattg

SEQ ID NO: 734298 - DNA, 25 bp, Artificial sequence
  Synthetic oligonucleotide
tattttaacgattaatatctgtaag

SEQ ID NO: 734299 - DNA, 25 bp, Artificial sequence
  Synthetic oligonucleotide
acttctataacatttcgaatttaaa

SEQ ID NO: 734300 - DNA, 25 bp, Artificial sequence
  Synthetic oligonucleotide
tctatttagtattttattcgttaag

SEQ ID NO: 734301 - DNA, 25 bp, Artificial sequence
  Synthetic oligonucleotide
tctatttagtatattattcgttaag

SEQ ID NO: 734302 - DNA, 25 bp, Artificial sequence
  Synthetic oligonucleotide
aacataatactttttgcgattaaat

SEQ ID NO: 734303 - DNA, 25 bp, Artificial sequence
  Synthetic oligonucleotide
aacataatacttattgcgattaaat

SEQ ID NO: 734304 - DNA, 25 bp, Artificial sequence
  Synthetic oligonucleotide
ttttttatcgtaaatctatatgaag

SEQ ID NO: 734305 - DNA, 25 bp, Artificial sequence
  Synthetic oligonucleotide
tatattataagttcgtattatactg

SEQ ID NO: 734306 - DNA, 25 bp, Artificial sequence
  Synthetic oligonucleotide
tatattataagtacgtattatactg

SEQ ID NO: 734307 - DNA, 25 bp, Artificial sequence
  Synthetic oligonucleotide
aatagatcaaattttgaacgttaaa

SEQ ID NO: 734308 - DNA, 25 bp, Artificial sequence
  Synthetic oligonucleotide
aatagatcaaatattgaacgttaaa

SEQ ID NO: 734309 - DNA, 25 bp, Artificial sequence
  Synthetic oligonucleotide
aaatattagattggatctattagta

SEQ ID NO: 734310 - DNA, 25 bp, Artificial sequence
  Synthetic oligonucleotide
aaatattagattcgatctattagta

SEQ ID NO: 734311 - DNA, 25 bp, Artificial sequence
  Synthetic oligonucleotide
gttctctataaccatattattaatt

SEQ ID NO: 734312 - DNA, 25 bp, Artificial sequence
  Synthetic oligonucleotide
atattttcgaatagttattatcgat

SEQ ID NO: 734313 - DNA, 25 bp, Artificial sequence
  Synthetic oligonucleotide
gttctctataacgatattattaatt

SEQ ID NO: 734314 - DNA, 25 bp, Artificial sequence
  Synthetic oligonucleotide
acttctataacaattcgaatttaaa

SEQ ID NO: 734315 - DNA, 25 bp, Artificial sequence
  Synthetic oligonucleotide
tgtattataataggtctaaactata

SEQ ID NO: 734316 - DNA, 25 bp, Artificial sequence
  Synthetic oligonucleotide
tgtattataatacgtctaaactata

SEQ ID NO: 734317 - DNA, 25 bp, Artificial sequence
  Synthetic oligonucleotide
aatgtctataacgaaaattctataa

SEQ ID NO: 734318 - DNA, 25 bp, Artificial sequence
  Synthetic oligonucleotide
atatattatcgataatcaatacgta

SEQ ID NO: 734319 - DNA, 25 bp, Artificial sequence
  Synthetic oligonucleotide
tttctttatatcctataagatgatt

SEQ ID NO: 734320 - DNA, 25 bp, Artificial sequence
  Synthetic oligonucleotide
tttctttatatcgtataagatgatt

SEQ ID NO: 734321 - DNA, 25 bp, Artificial sequence
  Synthetic oligonucleotide
tcaaatttaagttaattcgtacaat

SEQ ID NO: 734322 - DNA, 25 bp, Artificial sequence
  Synthetic oligonucleotide
ttttttatcgtatatctatatgaag

SEQ ID NO: 734323 - DNA, 25 bp, Artificial sequence
  Synthetic oligonucleotide
tttctattatttatctacgatatag

SEQ ID NO: 734324 - DNA, 25 bp, Artificial sequence
  Synthetic oligonucleotide
atcattaacgattgttatatttgaa

SEQ ID NO: 734325 - DNA, 25 bp, Artificial sequence
  Synthetic oligonucleotide
tttctattatttttctacgatatag

SEQ ID NO: 734326 - DNA, 25 bp, Artificial sequence
  Synthetic oligonucleotide
atattttcgaattgttattatcgat

SEQ ID NO: 734327 - DNA, 25 bp, Artificial sequence
  Synthetic oligonucleotide
gtattatcataattcgtatagtaat

SEQ ID NO: 734328 - DNA, 25 bp, Artificial sequence
  Synthetic oligonucleotide
aataaacttattatattcgactatc

SEQ ID NO: 734329 - DNA, 25 bp, Artificial sequence
  Synthetic oligonucleotide
tctctttattatggaactaaaaata

SEQ ID NO: 734330 - DNA, 25 bp, Artificial sequence
  Synthetic oligonucleotide
tctctttattatcgaactaaaaata

SEQ ID NO: 734331 - DNA, 25 bp, Artificial sequence
  Synthetic oligonucleotide
aaacaacgtttatatataagcttaa

SEQ ID NO: 734332 - DNA, 25 bp, Artificial sequence
  Synthetic oligonucleotide
aaacaacgtttaaatataagcttaa

SEQ ID NO: 734333 - DNA, 25 bp, Artificial sequence
  Synthetic oligonucleotide
ttttttcgaaatagataattgcaaa

SEQ ID NO: 734334 - DNA, 25 bp, Artificial sequence
  Synthetic oligonucleotide
ttaattaatctttacatacgttact

SEQ ID NO: 734335 - DNA, 25 bp, Artificial sequence
  Synthetic oligonucleotide
ttaattaatcttaacatacgttact

SEQ ID NO: 734336 - DNA, 25 bp, Artificial sequence
  Synthetic oligonucleotide
taaaatactataataatgcgaagat

SEQ ID NO: 734337 - DNA, 25 bp, Artificial sequence
  Synthetic oligonucleotide
taaaatactatattaatgcgaagat

SEQ ID NO: 734338 - DNA, 25 bp, Artificial sequence
  Synthetic oligonucleotide
tcttttatgttccatataatgaaat

SEQ ID NO: 734339 - DNA, 25 bp, Artificial sequence
  Synthetic oligonucleotide
aataaacttattttattcgactatc

SEQ ID NO: 734340 - DNA, 25 bp, Artificial sequence
  Synthetic oligonucleotide
gtattatcataaatcgtatagtaat

SEQ ID NO: 734341 - DNA, 25 bp, Artificial sequence
  Synthetic oligonucleotide
ttttttcgaaattgataattgcaaa

SEQ ID NO: 734342 - DNA, 25 bp, Artificial sequence
  Synthetic oligonucleotide
tatagacgtagatctaataaatatt

SEQ ID NO: 734343 - DNA, 25 bp, Artificial sequence
  Synthetic oligonucleotide
tatagacgtagaactaataaatatt

SEQ ID NO: 734344 - DNA, 25 bp, Artificial sequence
  Synthetic oligonucleotide
ataattaatcaatttattcgcagtt

SEQ ID NO: 734345 - DNA, 25 bp, Artificial sequence
  Synthetic oligonucleotide
ataattaatcaaattattcgcagtt

SEQ ID NO: 734346 - DNA, 25 bp, Artificial sequence
  Synthetic oligonucleotide
tgatcatttatgtttaaacgtttta

SEQ ID NO: 734347 - DNA, 25 bp, Artificial sequence
  Synthetic oligonucleotide
ctaaaataatatggctgtaattaaa

SEQ ID NO: 734348 - DNA, 25 bp, Artificial sequence
  Synthetic oligonucleotide
tcaaatttaagtaaattcgtacaat

SEQ ID NO: 734349 - DNA, 25 bp, Artificial sequence
  Synthetic oligonucleotide
tgatcatttatgattaaacgtttta

SEQ ID NO: 734350 - DNA, 25 bp, Artificial sequence
  Synthetic oligonucleotide
gaaacagtattaatatcgaaattat

SEQ ID NO: 734351 - DNA, 25 bp, Artificial sequence
  Synthetic oligonucleotide
tcttttatgttcgatataatgaaat

SEQ ID NO: 734352 - DNA, 25 bp, Artificial sequence
  Synthetic oligonucleotide
gaaacagtattattatcgaaattat

SEQ ID NO: 734353 - DNA, 25 bp, Artificial sequence
  Synthetic oligonucleotide
atctaaatacgaaatctatttacta

SEQ ID NO: 734354 - DNA, 25 bp, Artificial sequence
  Synthetic oligonucleotide
ttgaacgtttaaatagaataatctt

SEQ ID NO: 734355 - DNA, 25 bp, Artificial sequence
  Synthetic oligonucleotide
atgaatacgaatcattattagataa

SEQ ID NO: 734356 - DNA, 25 bp, Artificial sequence
  Synthetic oligonucleotide
ttatttacgtattaatcgtttgtta

SEQ ID NO: 734357 - DNA, 25 bp, Artificial sequence
  Synthetic oligonucleotide
atgaatacgaatgattattagataa

SEQ ID NO: 734358 - DNA, 25 bp, Artificial sequence
  Synthetic oligonucleotide
ttatttacgtataaatcgtttgtta

SEQ ID NO: 734359 - DNA, 25 bp, Artificial sequence
  Synthetic oligonucleotide
tatattataatttcgtaatgttcga

SEQ ID NO: 734360 - DNA, 25 bp, Artificial sequence
  Synthetic oligonucleotide
atctaaatacgatatctatttacta

SEQ ID NO: 734361 - DNA, 25 bp, Artificial sequence
  Synthetic oligonucleotide
ataatttatgttagtttcgtcttat

SEQ ID NO: 734362 - DNA, 25 bp, Artificial sequence
  Synthetic oligonucleotide
tatattataattacgtaatgttcga

SEQ ID NO: 734363 - DNA, 25 bp, Artificial sequence
  Synthetic oligonucleotide
ctaaaataatatcgctgtaattaaa

SEQ ID NO: 734364 - DNA, 25 bp, Artificial sequence
  Synthetic oligonucleotide
tttgatcgaaattattagtttaaac

SEQ ID NO: 734365 - DNA, 25 bp, Artificial sequence
  Synthetic oligonucleotide
tttgatcgaaataattagtttaaac

SEQ ID NO: 734366 - DNA, 25 bp, Artificial sequence
  Synthetic oligonucleotide
tttttatagttatcgataaattcga

SEQ ID NO: 734367 - DNA, 25 bp, Artificial sequence
  Synthetic oligonucleotide
tttttatagttaacgataaattcga

SEQ ID NO: 734368 - DNA, 25 bp, Artificial sequence
  Synthetic oligonucleotide
tatttttcgaaagttattatgacta

SEQ ID NO: 734369 - DNA, 25 bp, Artificial sequence
  Synthetic oligonucleotide
ataatttatgtttgtttcgtcttat

SEQ ID NO: 734370 - DNA, 25 bp, Artificial sequence
  Synthetic oligonucleotide
taacatcggtatcattaataaaata

SEQ ID NO: 734371 - DNA, 25 bp, Artificial sequence
  Synthetic oligonucleotide
taacatcggtatgattaataaaata

SEQ ID NO: 734372 - DNA, 25 bp, Artificial sequence
  Synthetic oligonucleotide
tttaacgtattggtctttaaaaata

SEQ ID NO: 734373 - DNA, 25 bp, Artificial sequence
  Synthetic oligonucleotide
tttaacgtattgctctttaaaaata

SEQ ID NO: 734374 - DNA, 25 bp, Artificial sequence
  Synthetic oligonucleotide
tatttttcgaaacttattatgacta

SEQ ID NO: 734375 - DNA, 25 bp, Artificial sequence
  Synthetic oligonucleotide
ttgaacgtttaattagaataatctt

SEQ ID NO: 734376 - DNA, 25 bp, Artificial sequence
  Synthetic oligonucleotide
atccttttataatgttcgatttata

SEQ ID NO: 734377 - DNA, 25 bp, Artificial sequence
  Synthetic oligonucleotide
cttaaatcggtattataatattact

SEQ ID NO: 734378 - DNA, 25 bp, Artificial sequence
  Synthetic oligonucleotide
atccttttataaagttcgatttata

SEQ ID NO: 734379 - DNA, 25 bp, Artificial sequence
  Synthetic oligonucleotide
aattattattcgtaatctaaatcga

SEQ ID NO: 734380 - DNA, 25 bp, Artificial sequence
  Synthetic oligonucleotide
aattattattcgaaatctaaatcga

SEQ ID NO: 734381 - DNA, 25 bp, Artificial sequence
  Synthetic oligonucleotide
cttaaatcggtaatataatattact

SEQ ID NO: 734382 - DNA, 25 bp, Artificial sequence
  Synthetic oligonucleotide
aataatcaactttgttcgaactaaa

SEQ ID NO: 734383 - DNA, 25 bp, Artificial sequence
  Synthetic oligonucleotide
aataatcaacttagttcgaactaaa

SEQ ID NO: 734384 - DNA, 25 bp, Artificial sequence
  Synthetic oligonucleotide
ttattaatagtccttagataccaat

SEQ ID NO: 734385 - DNA, 25 bp, Artificial sequence
  Synthetic oligonucleotide
tctgtatcgatgaaaattaaatgtt

SEQ ID NO: 734386 - DNA, 25 bp, Artificial sequence
  Synthetic oligonucleotide
cactattacgttttaactataaatg

SEQ ID NO: 734387 - DNA, 25 bp, Artificial sequence
  Synthetic oligonucleotide
tatatatcttatatcgcataaacct

SEQ ID NO: 734388 - DNA, 25 bp, Artificial sequence
  Synthetic oligonucleotide
tatatatcttatttcgcataaacct

SEQ ID NO: 734389 - DNA, 25 bp, Artificial sequence
  Synthetic oligonucleotide
ttatgtataattacgcataatacga

SEQ ID NO: 734390 - DNA, 25 bp, Artificial sequence
  Synthetic oligonucleotide
tctgtatcgatgtaaattaaatgtt

SEQ ID NO: 734391 - DNA, 25 bp, Artificial sequence
  Synthetic oligonucleotide
ttattaatagtcgttagataccaat

SEQ ID NO: 734392 - DNA, 25 bp, Artificial sequence
  Synthetic oligonucleotide
cactattacgttataactataaatg

SEQ ID NO: 734393 - DNA, 25 bp, Artificial sequence
  Synthetic oligonucleotide
taagggtacgataaattaattatct

SEQ ID NO: 734394 - DNA, 25 bp, Artificial sequence
  Synthetic oligonucleotide
cataaacaaatcgctaataaatctt

SEQ ID NO: 734395 - DNA, 25 bp, Artificial sequence
  Synthetic oligonucleotide
ttatgtataatttcgcataatacga

SEQ ID NO: 734396 - DNA, 25 bp, Artificial sequence
  Synthetic oligonucleotide
gtattatatcgataaagattcatct

SEQ ID NO: 734397 - DNA, 25 bp, Artificial sequence
  Synthetic oligonucleotide
gtattatatcgaaaaagattcatct

SEQ ID NO: 734398 - DNA, 25 bp, Artificial sequence
  Synthetic oligonucleotide
tacacttatacggttaaattcatat

SEQ ID NO: 734399 - DNA, 25 bp, Artificial sequence
  Synthetic oligonucleotide
atataaacgttatcgtattagtgat

SEQ ID NO: 734400 - DNA, 25 bp, Artificial sequence
  Synthetic oligonucleotide
taagggtacgattaattaattatct

SEQ ID NO: 734401 - DNA, 25 bp, Artificial sequence
  Synthetic oligonucleotide
ttacagtaaatccaacaataattga

SEQ ID NO: 734402 - DNA, 25 bp, Artificial sequence
  Synthetic oligonucleotide
atataaacgttaacgtattagtgat

SEQ ID NO: 734403 - DNA, 25 bp, Artificial sequence
  Synthetic oligonucleotide
taataatattagattacgaaagcac

SEQ ID NO: 734404 - DNA, 25 bp, Artificial sequence
  Synthetic oligonucleotide
taataatattagtttacgaaagcac

SEQ ID NO: 734405 - DNA, 25 bp, Artificial sequence
  Synthetic oligonucleotide
taattaattacgttcgtttaagaag

SEQ ID NO: 734406 - DNA, 25 bp, Artificial sequence
  Synthetic oligonucleotide
taattaattacgatcgtttaagaag

SEQ ID NO: 734407 - DNA, 25 bp, Artificial sequence
  Synthetic oligonucleotide
ttacagtaaatcgaacaataattga

SEQ ID NO: 734408 - DNA, 25 bp, Artificial sequence
  Synthetic oligonucleotide
tacacttatacgcttaaattcatat

SEQ ID NO: 734409 - DNA, 25 bp, Artificial sequence
  Synthetic oligonucleotide
tacgtctaatctatatatcgaaatt

SEQ ID NO: 734410 - DNA, 25 bp, Artificial sequence
  Synthetic oligonucleotide
atgaaagcgttattattaacaaaga

SEQ ID NO: 734411 - DNA, 25 bp, Artificial sequence
  Synthetic oligonucleotide
acatcgattcaaaaatacgatttta

SEQ ID NO: 734412 - DNA, 25 bp, Artificial sequence
  Synthetic oligonucleotide
acatcgattcaataatacgatttta

SEQ ID NO: 734413 - DNA, 25 bp, Artificial sequence
  Synthetic oligonucleotide
aggtaattaactaattacgagaata

SEQ ID NO: 734414 - DNA, 25 bp, Artificial sequence
  Synthetic oligonucleotide
aggtaattaacttattacgagaata

SEQ ID NO: 734415 - DNA, 25 bp, Artificial sequence
  Synthetic oligonucleotide
aaatacgtattaggattttatgaac

SEQ ID NO: 734416 - DNA, 25 bp, Artificial sequence
  Synthetic oligonucleotide
aaatacgtattacgattttatgaac

SEQ ID NO: 734417 - DNA, 25 bp, Artificial sequence
  Synthetic oligonucleotide
aattctgtcgaactaatatatagat

SEQ ID NO: 734418 - DNA, 25 bp, Artificial sequence
  Synthetic oligonucleotide
tttggagtaatccaattatatgtat

SEQ ID NO: 734419 - DNA, 25 bp, Artificial sequence
  Synthetic oligonucleotide
tacgtctaatctttatatcgaaatt

SEQ ID NO: 734420 - DNA, 25 bp, Artificial sequence
  Synthetic oligonucleotide
tcaattatatccgattagatatact

SEQ ID NO: 734421 - DNA, 25 bp, Artificial sequence
  Synthetic oligonucleotide
aactttgttgtgatatatcgatata

SEQ ID NO: 734422 - DNA, 25 bp, Artificial sequence
  Synthetic oligonucleotide
aactttgttgtgttatatcgatata

SEQ ID NO: 734423 - DNA, 25 bp, Artificial sequence
  Synthetic oligonucleotide
catacaaataattgttcgattcaaa

SEQ ID NO: 734424 - DNA, 25 bp, Artificial sequence
  Synthetic oligonucleotide
catacaaataatagttcgattcaaa

SEQ ID NO: 734425 - DNA, 25 bp, Artificial sequence
  Synthetic oligonucleotide
ttgtttatttcgtaatattcagctt

SEQ ID NO: 734426 - DNA, 25 bp, Artificial sequence
  Synthetic oligonucleotide
attagatcgtaatatgtaaattgca

SEQ ID NO: 734427 - DNA, 25 bp, Artificial sequence
  Synthetic oligonucleotide
attagatcgtaaaatgtaaattgca

SEQ ID NO: 734428 - DNA, 25 bp, Artificial sequence
  Synthetic oligonucleotide
aaacttaagtataagtatcgaaaga

SEQ ID NO: 734429 - DNA, 25 bp, Artificial sequence
  Synthetic oligonucleotide
aaacttaagtattagtatcgaaaga

SEQ ID NO: 734430 - DNA, 25 bp, Artificial sequence
  Synthetic oligonucleotide
aattctgtcgaagtaatatatagat

SEQ ID NO: 734431 - DNA, 25 bp, Artificial sequence
  Synthetic oligonucleotide
actcaaaaaataggtcgattaaata

SEQ ID NO: 734432 - DNA, 25 bp, Artificial sequence
  Synthetic oligonucleotide
tactattacttattaacgcttagta

SEQ ID NO: 734433 - DNA, 25 bp, Artificial sequence
  Synthetic oligonucleotide
tagaatactaagcgagtttatatta

SEQ ID NO: 734434 - DNA, 25 bp, Artificial sequence
  Synthetic oligonucleotide
tagaatactaagggagtttatatta

SEQ ID NO: 734435 - DNA, 25 bp, Artificial sequence
  Synthetic oligonucleotide
ctaagcttattaatacgaaatcttt

SEQ ID NO: 734436 - DNA, 25 bp, Artificial sequence
  Synthetic oligonucleotide
ctaagcttattattacgaaatcttt

SEQ ID NO: 734437 - DNA, 25 bp, Artificial sequence
  Synthetic oligonucleotide
tatcagtcgatatagtttatgaaat

SEQ ID NO: 734438 - DNA, 25 bp, Artificial sequence
  Synthetic oligonucleotide
tatcagtcgataaagtttatgaaat

SEQ ID NO: 734439 - DNA, 25 bp, Artificial sequence
  Synthetic oligonucleotide
taaatgcgttatttttcactgataa

SEQ ID NO: 734440 - DNA, 25 bp, Artificial sequence
  Synthetic oligonucleotide
tttggagtaatcgaattatatgtat

SEQ ID NO: 734441 - DNA, 25 bp, Artificial sequence
  Synthetic oligonucleotide
actcaaaaaatacgtcgattaaata

SEQ ID NO: 734442 - DNA, 25 bp, Artificial sequence
  Synthetic oligonucleotide
tactattacttaataacgcttagta

SEQ ID NO: 734443 - DNA, 25 bp, Artificial sequence
  Synthetic oligonucleotide
ttttttaatcgattgtattgatctc

SEQ ID NO: 734444 - DNA, 25 bp, Artificial sequence
  Synthetic oligonucleotide
ttttttaatcgaatgtattgatctc

SEQ ID NO: 734445 - DNA, 25 bp, Artificial sequence
  Synthetic oligonucleotide
atgaaagcgttaatattaacaaaga

SEQ ID NO: 734446 - DNA, 25 bp, Artificial sequence
  Synthetic oligonucleotide
cataaacaaatccctaataaatctt

SEQ ID NO: 734447 - DNA, 25 bp, Artificial sequence
  Synthetic oligonucleotide
tgcatcgataataatagttaaagaa

SEQ ID NO: 734448 - DNA, 25 bp, Artificial sequence
  Synthetic oligonucleotide
tgcatcgataattatagttaaagaa

SEQ ID NO: 734449 - DNA, 25 bp, Artificial sequence
  Synthetic oligonucleotide
aaagtaatccgatcttatagttata

SEQ ID NO: 734450 - DNA, 25 bp, Artificial sequence
  Synthetic oligonucleotide
aaagtaatccgaacttatagttata

SEQ ID NO: 734451 - DNA, 25 bp, Artificial sequence
  Synthetic oligonucleotide
tcaattatatcccattagatatact

SEQ ID NO: 734452 - DNA, 25 bp, Artificial sequence
  Synthetic oligonucleotide
taaatgcgttatatttcactgataa

SEQ ID NO: 734453 - DNA, 25 bp, Artificial sequence
  Synthetic oligonucleotide
actattatttagcgactaaattgat

SEQ ID NO: 734454 - DNA, 25 bp, Artificial sequence
  Synthetic oligonucleotide
atacaattatatgggattaattcag

SEQ ID NO: 734455 - DNA, 25 bp, Artificial sequence
  Synthetic oligonucleotide
aacaccgtaatatatcttgtatatt

SEQ ID NO: 734456 - DNA, 25 bp, Artificial sequence
  Synthetic oligonucleotide
aacaccgtaataaatcttgtatatt

SEQ ID NO: 734457 - DNA, 25 bp, Artificial sequence
  Synthetic oligonucleotide
ctagagacgaaaattgtaaaatatt

SEQ ID NO: 734458 - DNA, 25 bp, Artificial sequence
  Synthetic oligonucleotide
ctagagacgaaatttgtaaaatatt

SEQ ID NO: 734459 - DNA, 25 bp, Artificial sequence
  Synthetic oligonucleotide
tacaacgtcataaagtattacttta

SEQ ID NO: 734460 - DNA, 25 bp, Artificial sequence
  Synthetic oligonucleotide
tacaacgtcatatagtattacttta

SEQ ID NO: 734461 - DNA, 25 bp, Artificial sequence
  Synthetic oligonucleotide
tacatatatcgtcgttataatttga

SEQ ID NO: 734462 - DNA, 25 bp, Artificial sequence
  Synthetic oligonucleotide
tattaatattgattttcggtatagg

SEQ ID NO: 734463 - DNA, 25 bp, Artificial sequence
  Synthetic oligonucleotide
tatcgatatcgaattaatacactaa

SEQ ID NO: 734464 - DNA, 25 bp, Artificial sequence
  Synthetic oligonucleotide
actattatttagggactaaattgat

SEQ ID NO: 734465 - DNA, 25 bp, Artificial sequence
  Synthetic oligonucleotide
aaaggatatatcggttaatacattt

SEQ ID NO: 734466 - DNA, 25 bp, Artificial sequence
  Synthetic oligonucleotide
aaaggatatatccgttaatacattt

SEQ ID NO: 734467 - DNA, 25 bp, Artificial sequence
  Synthetic oligonucleotide
tattcctgattattcgataattcat

SEQ ID NO: 734468 - DNA, 25 bp, Artificial sequence
  Synthetic oligonucleotide
tattcctgattaatcgataattcat

SEQ ID NO: 734469 - DNA, 25 bp, Artificial sequence
  Synthetic oligonucleotide
attagcgattatgtacgtttattta

SEQ ID NO: 734470 - DNA, 25 bp, Artificial sequence
  Synthetic oligonucleotide
attagcgattatctacgtttattta

SEQ ID NO: 734471 - DNA, 25 bp, Artificial sequence
  Synthetic oligonucleotide
atacaattatatcggattaattcag

SEQ ID NO: 734472 - DNA, 25 bp, Artificial sequence
  Synthetic oligonucleotide
tattaatattgaatttcggtatagg

SEQ ID NO: 734473 - DNA, 25 bp, Artificial sequence
  Synthetic oligonucleotide
cacttctaatataatcgatattttg

SEQ ID NO: 734474 - DNA, 25 bp, Artificial sequence
  Synthetic oligonucleotide
ttaacaatcaatagtatcgttatgt

SEQ ID NO: 734475 - DNA, 25 bp, Artificial sequence
  Synthetic oligonucleotide
taaaaacgatatttagctatttcgt

SEQ ID NO: 734476 - DNA, 25 bp, Artificial sequence
  Synthetic oligonucleotide
aagtttagcgataaataagtatgta

SEQ ID NO: 734477 - DNA, 25 bp, Artificial sequence
  Synthetic oligonucleotide
tttctttctatccttcaatatagta

SEQ ID NO: 734478 - DNA, 25 bp, Artificial sequence
  Synthetic oligonucleotide
ttaacaatcaattgtatcgttatgt

SEQ ID NO: 734479 - DNA, 25 bp, Artificial sequence
  Synthetic oligonucleotide
atcaagcgatcatgttattatttat

SEQ ID NO: 734480 - DNA, 25 bp, Artificial sequence
  Synthetic oligonucleotide
atcaagcgatcaagttattatttat

SEQ ID NO: 734481 - DNA, 25 bp, Artificial sequence
  Synthetic oligonucleotide
tacatatatcgtggttataatttga

SEQ ID NO: 734482 - DNA, 25 bp, Artificial sequence
  Synthetic oligonucleotide
ttttattcgtacaatcaaaaatgtc

SEQ ID NO: 734483 - DNA, 25 bp, Artificial sequence
  Synthetic oligonucleotide
aattacgaattatttatctagcact

SEQ ID NO: 734484 - DNA, 25 bp, Artificial sequence
  Synthetic oligonucleotide
cacttctaatattatcgatattttg

SEQ ID NO: 734485 - DNA, 25 bp, Artificial sequence
  Synthetic oligonucleotide
aaacaatcgtaaatttcgcaaatta

SEQ ID NO: 734486 - DNA, 25 bp, Artificial sequence
  Synthetic oligonucleotide
aaacaatcgtaattttcgcaaatta

SEQ ID NO: 734487 - DNA, 25 bp, Artificial sequence
  Synthetic oligonucleotide
tattggatatttatcatacgttctt

SEQ ID NO: 734488 - DNA, 25 bp, Artificial sequence
  Synthetic oligonucleotide
tattggatatttttcatacgttctt

SEQ ID NO: 734489 - DNA, 25 bp, Artificial sequence
  Synthetic oligonucleotide
attaggattttttcgcttatttatc

SEQ ID NO: 734490 - DNA, 25 bp, Artificial sequence
  Synthetic oligonucleotide
attaggatttttacgcttatttatc

SEQ ID NO: 734491 - DNA, 25 bp, Artificial sequence
  Synthetic oligonucleotide
tatcgatatcgatttaatacactaa

SEQ ID NO: 734492 - DNA, 25 bp, Artificial sequence
  Synthetic oligonucleotide
ttttattcgtactatcaaaaatgtc

SEQ ID NO: 734493 - DNA, 25 bp, Artificial sequence
  Synthetic oligonucleotide
gttaacgctaacacttatatatata

SEQ ID NO: 734494 - DNA, 25 bp, Artificial sequence
  Synthetic oligonucleotide
ttgtttatttcgaaatattcagctt

SEQ ID NO: 734495 - DNA, 25 bp, Artificial sequence
  Synthetic oligonucleotide
aatatgtacggtataattaaggaat

SEQ ID NO: 734496 - DNA, 25 bp, Artificial sequence
  Synthetic oligonucleotide
aatatgtacggtttaattaaggaat

SEQ ID NO: 734497 - DNA, 25 bp, Artificial sequence
  Synthetic oligonucleotide
atgaataaactttcgctttaaaatg

SEQ ID NO: 734498 - DNA, 25 bp, Artificial sequence
  Synthetic oligonucleotide
atgaataaacttacgctttaaaatg

SEQ ID NO: 734499 - DNA, 25 bp, Artificial sequence
  Synthetic oligonucleotide
aagtagattattaaacgcttcattt

SEQ ID NO: 734500 - DNA, 25 bp, Artificial sequence
  Synthetic oligonucleotide
aagtagattatttaacgcttcattt

SEQ ID NO: 734501 - DNA, 25 bp, Artificial sequence
  Synthetic oligonucleotide
gtaaaaagttcgtttgaatatgata

SEQ ID NO: 734502 - DNA, 25 bp, Artificial sequence
  Synthetic oligonucleotide
catttgcgtatcaataataatactt

SEQ ID NO: 734503 - DNA, 25 bp, Artificial sequence
  Synthetic oligonucleotide
ttttttaatttcgtcaattagtcca

SEQ ID NO: 734504 - DNA, 25 bp, Artificial sequence
  Synthetic oligonucleotide
gttaacgctaactcttatatatata

SEQ ID NO: 734505 - DNA, 25 bp, Artificial sequence
  Synthetic oligonucleotide
atttcgtaataaatcgtatatgtag

SEQ ID NO: 734506 - DNA, 25 bp, Artificial sequence
  Synthetic oligonucleotide
atttcgtaataattcgtatatgtag

SEQ ID NO: 734507 - DNA, 25 bp, Artificial sequence
  Synthetic oligonucleotide
tcgtacgcaagtatattattaaaaa

SEQ ID NO: 734508 - DNA, 25 bp, Artificial sequence
  Synthetic oligonucleotide
tcgtacgcaagtttattattaaaaa

SEQ ID NO: 734509 - DNA, 25 bp, Artificial sequence
  Synthetic oligonucleotide
tcataatttacgatatacgataact

SEQ ID NO: 734510 - DNA, 25 bp, Artificial sequence
  Synthetic oligonucleotide
tcataatttacgttatacgataact

SEQ ID NO: 734511 - DNA, 25 bp, Artificial sequence
  Synthetic oligonucleotide
caacttaacaataaatcgtaacaaa

SEQ ID NO: 734512 - DNA, 25 bp, Artificial sequence
  Synthetic oligonucleotide
catttgcgtatctataataatactt

SEQ ID NO: 734513 - DNA, 25 bp, Artificial sequence
  Synthetic oligonucleotide
caatacaatctaattacgaagatta

SEQ ID NO: 734514 - DNA, 25 bp, Artificial sequence
  Synthetic oligonucleotide
aattacgaattaattatctagcact

SEQ ID NO: 734515 - DNA, 25 bp, Artificial sequence
  Synthetic oligonucleotide
gtcctgtatattttaatcgattaaa

SEQ ID NO: 734516 - DNA, 25 bp, Artificial sequence
  Synthetic oligonucleotide
gtcctgtatattataatcgattaaa

SEQ ID NO: 734517 - DNA, 25 bp, Artificial sequence
  Synthetic oligonucleotide
ggtatttatacgtttacttatacaa

SEQ ID NO: 734518 - DNA, 25 bp, Artificial sequence
  Synthetic oligonucleotide
ggtatttatacgattacttatacaa

SEQ ID NO: 734519 - DNA, 25 bp, Artificial sequence
  Synthetic oligonucleotide
atgattcgattattaatctaaaacg

SEQ ID NO: 734520 - DNA, 25 bp, Artificial sequence
  Synthetic oligonucleotide
atgattcgattaataatctaaaacg

SEQ ID NO: 734521 - DNA, 25 bp, Artificial sequence
  Synthetic oligonucleotide
gtaaaaagttcgattgaatatgata

SEQ ID NO: 734522 - DNA, 25 bp, Artificial sequence
  Synthetic oligonucleotide
gtgattaattttcgactaaatactt

SEQ ID NO: 734523 - DNA, 25 bp, Artificial sequence
  Synthetic oligonucleotide
caacttaacaattaatcgtaacaaa

SEQ ID NO: 734524 - DNA, 25 bp, Artificial sequence
  Synthetic oligonucleotide
caatacaatctatttacgaagatta

SEQ ID NO: 734525 - DNA, 25 bp, Artificial sequence
  Synthetic oligonucleotide
aaagttctattcgatataaaatcgt

SEQ ID NO: 734526 - DNA, 25 bp, Artificial sequence
  Synthetic oligonucleotide
aaagttctattccatataaaatcgt

SEQ ID NO: 734527 - DNA, 25 bp, Artificial sequence
  Synthetic oligonucleotide
aagatgtatatttagcgaatattag

SEQ ID NO: 734528 - DNA, 25 bp, Artificial sequence
  Synthetic oligonucleotide
aagatgtatattaagcgaatattag

SEQ ID NO: 734529 - DNA, 25 bp, Artificial sequence
  Synthetic oligonucleotide
aaagttttcgatcatcatatactaa

SEQ ID NO: 734530 - DNA, 25 bp, Artificial sequence
  Synthetic oligonucleotide
aaagttttcgatgatcatatactaa

SEQ ID NO: 734531 - DNA, 25 bp, Artificial sequence
  Synthetic oligonucleotide
ttttttaatttcctcaattagtcca

SEQ ID NO: 734532 - DNA, 25 bp, Artificial sequence
  Synthetic oligonucleotide
gtgattaattttggactaaatactt

SEQ ID NO: 734533 - DNA, 25 bp, Artificial sequence
  Synthetic oligonucleotide
cttacaattactgattatcgaaatt

SEQ ID NO: 734534 - DNA, 25 bp, Artificial sequence
  Synthetic oligonucleotide
ttttcgtcaatcgttatagaatata

SEQ ID NO: 734535 - DNA, 25 bp, Artificial sequence
  Synthetic oligonucleotide
aaattaattctacaacaacgagatt

SEQ ID NO: 734536 - DNA, 25 bp, Artificial sequence
  Synthetic oligonucleotide
aaattaattctagaacaacgagatt

SEQ ID NO: 734537 - DNA, 25 bp, Artificial sequence
  Synthetic oligonucleotide
gtaactattctatcgttaaagaatt

SEQ ID NO: 734538 - DNA, 25 bp, Artificial sequence
  Synthetic oligonucleotide
gtaactattctaacgttaaagaatt

SEQ ID NO: 734539 - DNA, 25 bp, Artificial sequence
  Synthetic oligonucleotide
gaaatctattcgtagtattattcat

SEQ ID NO: 734540 - DNA, 25 bp, Artificial sequence
  Synthetic oligonucleotide
gaaatctattcgaagtattattcat

SEQ ID NO: 734541 - DNA, 25 bp, Artificial sequence
  Synthetic oligonucleotide
aggtatatacgaaattcgaaataat

SEQ ID NO: 734542 - DNA, 25 bp, Artificial sequence
  Synthetic oligonucleotide
agtattaattaaatgacgattgcat

SEQ ID NO: 734543 - DNA, 25 bp, Artificial sequence
  Synthetic oligonucleotide
cttacaattactcattatcgaaatt

SEQ ID NO: 734544 - DNA, 25 bp, Artificial sequence
  Synthetic oligonucleotide
caagataatcatatttcgtaacttt

SEQ ID NO: 734545 - DNA, 25 bp, Artificial sequence
  Synthetic oligonucleotide
actgtcatattaggtaaagattaat

SEQ ID NO: 734546 - DNA, 25 bp, Artificial sequence
  Synthetic oligonucleotide
actgtcatattacgtaaagattaat

SEQ ID NO: 734547 - DNA, 25 bp, Artificial sequence
  Synthetic oligonucleotide
aatacgtcgataataagaacaataa

SEQ ID NO: 734548 - DNA, 25 bp, Artificial sequence
  Synthetic oligonucleotide
aatacgtcgatattaagaacaataa

SEQ ID NO: 734549 - DNA, 25 bp, Artificial sequence
  Synthetic oligonucleotide
atatataataatccgaactacaaca

SEQ ID NO: 734550 - DNA, 25 bp, Artificial sequence
  Synthetic oligonucleotide
atatataataatgcgaactacaaca

SEQ ID NO: 734551 - DNA, 25 bp, Artificial sequence
  Synthetic oligonucleotide
ttcctacgaatctatatttatattg

SEQ ID NO: 734552 - DNA, 25 bp, Artificial sequence
  Synthetic oligonucleotide
tattaactacgatattaactacatg

SEQ ID NO: 734553 - DNA, 25 bp, Artificial sequence
  Synthetic oligonucleotide
aggtatatacgatattcgaaataat

SEQ ID NO: 734554 - DNA, 25 bp, Artificial sequence
  Synthetic oligonucleotide
taagatatctataacgaaatatctg

SEQ ID NO: 734555 - DNA, 25 bp, Artificial sequence
  Synthetic oligonucleotide
gatattcgactaacataatatagat

SEQ ID NO: 734556 - DNA, 25 bp, Artificial sequence
  Synthetic oligonucleotide
ttatcatttcgacatattatcagat

SEQ ID NO: 734557 - DNA, 25 bp, Artificial sequence
  Synthetic oligonucleotide
agttacgtataattattaagtagct

SEQ ID NO: 734558 - DNA, 25 bp, Artificial sequence
  Synthetic oligonucleotide
agttacgtataaatattaagtagct

SEQ ID NO: 734559 - DNA, 25 bp, Artificial sequence
  Synthetic oligonucleotide
aaaatatatgcaaaacgatttgaag

SEQ ID NO: 734560 - DNA, 25 bp, Artificial sequence
  Synthetic oligonucleotide
aaaatatatgcataacgatttgaag

SEQ ID NO: 734561 - DNA, 25 bp, Artificial sequence
  Synthetic oligonucleotide
ttatgtaatacaaatagcgttatac

SEQ ID NO: 734562 - DNA, 25 bp, Artificial sequence
  Synthetic oligonucleotide
ttatgtaatacatatagcgttatac

SEQ ID NO: 734563 - DNA, 25 bp, Artificial sequence
  Synthetic oligonucleotide
agtattaattaattgacgattgcat

SEQ ID NO: 734564 - DNA, 25 bp, Artificial sequence
  Synthetic oligonucleotide
atttactattaatcgatagtgatga

SEQ ID NO: 734565 - DNA, 25 bp, Artificial sequence
  Synthetic oligonucleotide
ttttcgtcaatccttatagaatata

SEQ ID NO: 734566 - DNA, 25 bp, Artificial sequence
  Synthetic oligonucleotide
taagatatctattacgaaatatctg

SEQ ID NO: 734567 - DNA, 25 bp, Artificial sequence
  Synthetic oligonucleotide
tgaaaattatcgtttatcaacttgt

SEQ ID NO: 734568 - DNA, 25 bp, Artificial sequence
  Synthetic oligonucleotide
tgaaaattatcgattatcaacttgt

SEQ ID NO: 734569 - DNA, 25 bp, Artificial sequence
  Synthetic oligonucleotide
agtatttgaagtctcgtattaataa

SEQ ID NO: 734570 - DNA, 25 bp, Artificial sequence
  Synthetic oligonucleotide
agtatttgaagtgtcgtattaataa

SEQ ID NO: 734571 - DNA, 25 bp, Artificial sequence
  Synthetic oligonucleotide
gatattcgactatcataatatagat

SEQ ID NO: 734572 - DNA, 25 bp, Artificial sequence
  Synthetic oligonucleotide
aagtttagcgattaataagtatgta

SEQ ID NO: 734573 - DNA, 25 bp, Artificial sequence
  Synthetic oligonucleotide
caagataatcatttttcgtaacttt

SEQ ID NO: 734574 - DNA, 25 bp, Artificial sequence
  Synthetic oligonucleotide
atttactattaaacgatagtgatga

SEQ ID NO: 734575 - DNA, 25 bp, Artificial sequence
  Synthetic oligonucleotide
tataatgtacgaacgtaaatcaatt

SEQ ID NO: 734576 - DNA, 25 bp, Artificial sequence
  Synthetic oligonucleotide
ttcctacgaatcaatatttatattg

SEQ ID NO: 734577 - DNA, 25 bp, Artificial sequence
  Synthetic oligonucleotide
gtggttatcgtatatataagaaaat

SEQ ID NO: 734578 - DNA, 25 bp, Artificial sequence
  Synthetic oligonucleotide
gtggttatcgtaaatataagaaaat

SEQ ID NO: 734579 - DNA, 25 bp, Artificial sequence
  Synthetic oligonucleotide
tgaaattcgactatagataactatt

SEQ ID NO: 734580 - DNA, 25 bp, Artificial sequence
  Synthetic oligonucleotide
tgaaattcgactttagataactatt

SEQ ID NO: 734581 - DNA, 25 bp, Artificial sequence
  Synthetic oligonucleotide
gattgatcaaatttcgttgaattat

SEQ ID NO: 734582 - DNA, 25 bp, Artificial sequence
  Synthetic oligonucleotide
gattgatcaaatatcgttgaattat

SEQ ID NO: 734583 - DNA, 25 bp, Artificial sequence
  Synthetic oligonucleotide
aataattaacgcacgaatctaaaaa

SEQ ID NO: 734584 - DNA, 25 bp, Artificial sequence
  Synthetic oligonucleotide
atttaattattgacgaatcacgatt

SEQ ID NO: 734585 - DNA, 25 bp, Artificial sequence
  Synthetic oligonucleotide
tataatgtacgatcgtaaatcaatt

SEQ ID NO: 734586 - DNA, 25 bp, Artificial sequence
  Synthetic oligonucleotide
gacttagttcgaaaaatatgataaa

SEQ ID NO: 734587 - DNA, 25 bp, Artificial sequence
  Synthetic oligonucleotide
taaatggacgcgtttatatttataa

SEQ ID NO: 734588 - DNA, 25 bp, Artificial sequence
  Synthetic oligonucleotide
taaatggacgcgattatatttataa

SEQ ID NO: 734589 - DNA, 25 bp, Artificial sequence
  Synthetic oligonucleotide
acaattcgtcgatttactataaata

SEQ ID NO: 734590 - DNA, 25 bp, Artificial sequence
  Synthetic oligonucleotide
acaattcgtcgaattactataaata

SEQ ID NO: 734591 - DNA, 25 bp, Artificial sequence
  Synthetic oligonucleotide
acatatatatcttaacgcgattatt

SEQ ID NO: 734592 - DNA, 25 bp, Artificial sequence
  Synthetic oligonucleotide
acatatatatctaaacgcgattatt

SEQ ID NO: 734593 - DNA, 25 bp, Artificial sequence
  Synthetic oligonucleotide
taaaaacgatatatagctatttcgt

SEQ ID NO: 734594 - DNA, 25 bp, Artificial sequence
  Synthetic oligonucleotide
ctaaatcgctaaattatgtaaatca

SEQ ID NO: 734595 - DNA, 25 bp, Artificial sequence
  Synthetic oligonucleotide
aataattaacgctcgaatctaaaaa

SEQ ID NO: 734596 - DNA, 25 bp, Artificial sequence
  Synthetic oligonucleotide
tatgattacgcgaaaatattatttg

SEQ ID NO: 734597 - DNA, 25 bp, Artificial sequence
  Synthetic oligonucleotide
atgttcaatcgcaattaattgaaat

SEQ ID NO: 734598 - DNA, 25 bp, Artificial sequence
  Synthetic oligonucleotide
atgttcaatcgctattaattgaaat

SEQ ID NO: 734599 - DNA, 25 bp, Artificial sequence
  Synthetic oligonucleotide
cttattaatcgatacttatattggt

SEQ ID NO: 734600 - DNA, 25 bp, Artificial sequence
  Synthetic oligonucleotide
cttattaatcgaaacttatattggt

SEQ ID NO: 734601 - DNA, 25 bp, Artificial sequence
  Synthetic oligonucleotide
ataattatcaatatcgattgtaagg

SEQ ID NO: 734602 - DNA, 25 bp, Artificial sequence
  Synthetic oligonucleotide
ataattatcaatttcgattgtaagg

SEQ ID NO: 734603 - DNA, 25 bp, Artificial sequence
  Synthetic oligonucleotide
tacagtacgaattttaactattatg

SEQ ID NO: 734604 - DNA, 25 bp, Artificial sequence
  Synthetic oligonucleotide
tacagtacgaatattaactattatg

SEQ ID NO: 734605 - DNA, 25 bp, Artificial sequence
  Synthetic oligonucleotide
atttaattattgtcgaatcacgatt

SEQ ID NO: 734606 - DNA, 25 bp, Artificial sequence
  Synthetic oligonucleotide
gattatattacgtttagttagagat

SEQ ID NO: 734607 - DNA, 25 bp, Artificial sequence
  Synthetic oligonucleotide
tattaactacgaaattaactacatg

SEQ ID NO: 734608 - DNA, 25 bp, Artificial sequence
  Synthetic oligonucleotide
tatgattacgcgtaaatattatttg

SEQ ID NO: 734609 - DNA, 25 bp, Artificial sequence
  Synthetic oligonucleotide
caaatattagtctcatcgtatatat

SEQ ID NO: 734610 - DNA, 25 bp, Artificial sequence
  Synthetic oligonucleotide
caaatattagtcacatcgtatatat

SEQ ID NO: 734611 - DNA, 25 bp, Artificial sequence
  Synthetic oligonucleotide
aaattgtcgatatcttatatgaaca

SEQ ID NO: 734612 - DNA, 25 bp, Artificial sequence
  Synthetic oligonucleotide
aaattgtcgataacttatatgaaca

SEQ ID NO: 734613 - DNA, 25 bp, Artificial sequence
  Synthetic oligonucleotide
aataaaattacggaacaatttcaga

SEQ ID NO: 734614 - DNA, 25 bp, Artificial sequence
  Synthetic oligonucleotide
aataaaattacgcaacaatttcaga

SEQ ID NO: 734615 - DNA, 25 bp, Artificial sequence
  Synthetic oligonucleotide
gacttagttcgataaatatgataaa

SEQ ID NO: 734616 - DNA, 25 bp, Artificial sequence
  Synthetic oligonucleotide
gattatattacgattagttagagat

SEQ ID NO: 734617 - DNA, 25 bp, Artificial sequence
  Synthetic oligonucleotide
aaataattacttgataacgatttgg

SEQ ID NO: 734618 - DNA, 25 bp, Artificial sequence
  Synthetic oligonucleotide
agtatcgattaattaacgaacaatt

SEQ ID NO: 734619 - DNA, 25 bp, Artificial sequence
  Synthetic oligonucleotide
aataaatattcgtaaaattgtcgca

SEQ ID NO: 734620 - DNA, 25 bp, Artificial sequence
  Synthetic oligonucleotide
aataaatattcgaaaaattgtcgca

SEQ ID NO: 734621 - DNA, 25 bp, Artificial sequence
  Synthetic oligonucleotide
ctcgtcgatttaaatctatttaata

SEQ ID NO: 734622 - DNA, 25 bp, Artificial sequence
  Synthetic oligonucleotide
ctcgtcgatttatatctatttaata

SEQ ID NO: 734623 - DNA, 25 bp, Artificial sequence
  Synthetic oligonucleotide
ttttataattattatcggatgtagg

SEQ ID NO: 734624 - DNA, 25 bp, Artificial sequence
  Synthetic oligonucleotide
ttttataattataatcggatgtagg

SEQ ID NO: 734625 - DNA, 25 bp, Artificial sequence
  Synthetic oligonucleotide
tcttgcgtcgaaataatataaataa

SEQ ID NO: 734626 - DNA, 25 bp, Artificial sequence
  Synthetic oligonucleotide
gtaatattttttggagaaatagaac

SEQ ID NO: 734627 - DNA, 25 bp, Artificial sequence
  Synthetic oligonucleotide
aaataattacttcataacgatttgg

SEQ ID NO: 734628 - DNA, 25 bp, Artificial sequence
  Synthetic oligonucleotide
aaaaacgatagtttactaatgcaaa

SEQ ID NO: 734629 - DNA, 25 bp, Artificial sequence
  Synthetic oligonucleotide
agtttcgataactattactaatgtt

SEQ ID NO: 734630 - DNA, 25 bp, Artificial sequence
  Synthetic oligonucleotide
agtttcgataacaattactaatgtt

SEQ ID NO: 734631 - DNA, 25 bp, Artificial sequence
  Synthetic oligonucleotide
aatatttctattcgtactatatcac

SEQ ID NO: 734632 - DNA, 25 bp, Artificial sequence
  Synthetic oligonucleotide
aatatttctattggtactatatcac

SEQ ID NO: 734633 - DNA, 25 bp, Artificial sequence
  Synthetic oligonucleotide
tgattaacgaaagtcctaattaaat

SEQ ID NO: 734634 - DNA, 25 bp, Artificial sequence
  Synthetic oligonucleotide
tgattaacgaaactcctaattaaat

SEQ ID NO: 734635 - DNA, 25 bp, Artificial sequence
  Synthetic oligonucleotide
atttaaacagtaaaattcgagaatc

SEQ ID NO: 734636 - DNA, 25 bp, Artificial sequence
  Synthetic oligonucleotide
ttatcatttcgagatattatcagat

SEQ ID NO: 734637 - DNA, 25 bp, Artificial sequence
  Synthetic oligonucleotide
tcttgcgtcgaattaatataaataa

SEQ ID NO: 734638 - DNA, 25 bp, Artificial sequence
  Synthetic oligonucleotide
ataatgacctcgaattttatcttaa

SEQ ID NO: 734639 - DNA, 25 bp, Artificial sequence
  Synthetic oligonucleotide
aagcttaatatattataccgagatt

SEQ ID NO: 734640 - DNA, 25 bp, Artificial sequence
  Synthetic oligonucleotide
aagcttaatataatataccgagatt

SEQ ID NO: 734641 - DNA, 25 bp, Artificial sequence
  Synthetic oligonucleotide
gatcttaatcgaacgtaataatttt

SEQ ID NO: 734642 - DNA, 25 bp, Artificial sequence
  Synthetic oligonucleotide
gatcttaatcgatcgtaataatttt

SEQ ID NO: 734643 - DNA, 25 bp, Artificial sequence
  Synthetic oligonucleotide
ttatctcgttatttcataaccaata

SEQ ID NO: 734644 - DNA, 25 bp, Artificial sequence
  Synthetic oligonucleotide
ttatctcgttatatcataaccaata

SEQ ID NO: 734645 - DNA, 25 bp, Artificial sequence
  Synthetic oligonucleotide
ttcctttatggatattcgtattatt

SEQ ID NO: 734646 - DNA, 25 bp, Artificial sequence
  Synthetic oligonucleotide
ttcctttatggaaattcgtattatt

SEQ ID NO: 734647 - DNA, 25 bp, Artificial sequence
  Synthetic oligonucleotide
gtaatattttttcgagaaatagaac

SEQ ID NO: 734648 - DNA, 25 bp, Artificial sequence
  Synthetic oligonucleotide
agtcagatttcgaaataataatttc

SEQ ID NO: 734649 - DNA, 25 bp, Artificial sequence
  Synthetic oligonucleotide
agtatcgattaaataacgaacaatt

SEQ ID NO: 734650 - DNA, 25 bp, Artificial sequence
  Synthetic oligonucleotide
ataatgacctcgtattttatcttaa

SEQ ID NO: 734651 - DNA, 25 bp, Artificial sequence
  Synthetic oligonucleotide
gattatagcggttaatttaatttct

SEQ ID NO: 734652 - DNA, 25 bp, Artificial sequence
  Synthetic oligonucleotide
gattatagcggtaaatttaatttct

SEQ ID NO: 734653 - DNA, 25 bp, Artificial sequence
  Synthetic oligonucleotide
gattatgttcaaatcgtaagttata

SEQ ID NO: 734654 - DNA, 25 bp, Artificial sequence
  Synthetic oligonucleotide
gattatgttcaattcgtaagttata

SEQ ID NO: 734655 - DNA, 25 bp, Artificial sequence
  Synthetic oligonucleotide
attcgctatatcgaattataactta

SEQ ID NO: 734656 - DNA, 25 bp, Artificial sequence
  Synthetic oligonucleotide
attcgctatatccaattataactta

SEQ ID NO: 734657 - DNA, 25 bp, Artificial sequence
  Synthetic oligonucleotide
aaaaacgatagtatactaatgcaaa

SEQ ID NO: 734658 - DNA, 25 bp, Artificial sequence
  Synthetic oligonucleotide
agtcagatttcgtaataataatttc

SEQ ID NO: 734659 - DNA, 25 bp, Artificial sequence
  Synthetic oligonucleotide
caatggcgtaattttgttataaata

SEQ ID NO: 734660 - DNA, 25 bp, Artificial sequence
  Synthetic oligonucleotide
atttaaacagtataattcgagaatc

SEQ ID NO: 734661 - DNA, 25 bp, Artificial sequence
  Synthetic oligonucleotide
actgataatatactatacgaatctt

SEQ ID NO: 734662 - DNA, 25 bp, Artificial sequence
  Synthetic oligonucleotide
actgataatatagtatacgaatctt

SEQ ID NO: 734663 - DNA, 25 bp, Artificial sequence
  Synthetic oligonucleotide
ttttaatgcgatttcttatagtaca

SEQ ID NO: 734664 - DNA, 25 bp, Artificial sequence
  Synthetic oligonucleotide
ttttaatgcgatatcttatagtaca

SEQ ID NO: 734665 - DNA, 25 bp, Artificial sequence
  Synthetic oligonucleotide
caaatagtattccataaatctaagt

SEQ ID NO: 734666 - DNA, 25 bp, Artificial sequence
  Synthetic oligonucleotide
caaatagtattcgataaatctaagt

SEQ ID NO: 734667 - DNA, 25 bp, Artificial sequence
  Synthetic oligonucleotide
tgtttttaatcgaatgataagacta

SEQ ID NO: 734668 - DNA, 25 bp, Artificial sequence
  Synthetic oligonucleotide
agtttcattatatacgattaagact

SEQ ID NO: 734669 - DNA, 25 bp, Artificial sequence
  Synthetic oligonucleotide
caatggcgtaatattgttataaata

SEQ ID NO: 734670 - DNA, 25 bp, Artificial sequence
  Synthetic oligonucleotide
ctaacagttgatcgaatttaataat

SEQ ID NO: 734671 - DNA, 25 bp, Artificial sequence
  Synthetic oligonucleotide
gatatattaatccgatattacagat

SEQ ID NO: 734672 - DNA, 25 bp, Artificial sequence
  Synthetic oligonucleotide
gatatattaatcggatattacagat

SEQ ID NO: 734673 - DNA, 25 bp, Artificial sequence
  Synthetic oligonucleotide
tatgaaatattagtttatcgtaggt

SEQ ID NO: 734674 - DNA, 25 bp, Artificial sequence
  Synthetic oligonucleotide
tatgaaatattactttatcgtaggt

SEQ ID NO: 734675 - DNA, 25 bp, Artificial sequence
  Synthetic oligonucleotide
tattagtatatccgattaacttctt

SEQ ID NO: 734676 - DNA, 25 bp, Artificial sequence
  Synthetic oligonucleotide
tattagtatatcggattaacttctt

SEQ ID NO: 734677 - DNA, 25 bp, Artificial sequence
  Synthetic oligonucleotide
atgtaaacgaatacttataaatcgt

SEQ ID NO: 734678 - DNA, 25 bp, Artificial sequence
  Synthetic oligonucleotide
atgtaaacgaattcttataaatcgt

SEQ ID NO: 734679 - DNA, 25 bp, Artificial sequence
  Synthetic oligonucleotide
tgtttttaatcgtatgataagacta

SEQ ID NO: 734680 - DNA, 25 bp, Artificial sequence
  Synthetic oligonucleotide
atttctattatacttatcggttaag

SEQ ID NO: 734681 - DNA, 25 bp, Artificial sequence
  Synthetic oligonucleotide
ggatcactaatcctatataaaaata

SEQ ID NO: 734682 - DNA, 25 bp, Artificial sequence
  Synthetic oligonucleotide
ggatcactaatcgtatataaaaata

SEQ ID NO: 734683 - DNA, 25 bp, Artificial sequence
  Synthetic oligonucleotide
ataaaaaatagtacgattgccataa

SEQ ID NO: 734684 - DNA, 25 bp, Artificial sequence
  Synthetic oligonucleotide
ataaaaaatagttcgattgccataa

SEQ ID NO: 734685 - DNA, 25 bp, Artificial sequence
  Synthetic oligonucleotide
actgttagcgtatattaatacaaaa

SEQ ID NO: 734686 - DNA, 25 bp, Artificial sequence
  Synthetic oligonucleotide
actgttagcgtaaattaatacaaaa

SEQ ID NO: 734687 - DNA, 25 bp, Artificial sequence
  Synthetic oligonucleotide
ttcatttaatttaattcgcgtacaa

SEQ ID NO: 734688 - DNA, 25 bp, Artificial sequence
  Synthetic oligonucleotide
ttcatttaattttattcgcgtacaa

SEQ ID NO: 734689 - DNA, 25 bp, Artificial sequence
  Synthetic oligonucleotide
agtttcattataaacgattaagact

SEQ ID NO: 734690 - DNA, 25 bp, Artificial sequence
  Synthetic oligonucleotide
gttttagattaaacgtataattctg

SEQ ID NO: 734691 - DNA, 25 bp, Artificial sequence
  Synthetic oligonucleotide
tttctttctatcgttcaatatagta

SEQ ID NO: 734692 - DNA, 25 bp, Artificial sequence
  Synthetic oligonucleotide
atttctattatagttatcggttaag

SEQ ID NO: 734693 - DNA, 25 bp, Artificial sequence
  Synthetic oligonucleotide
tttaatacgttattggttatgagtt

SEQ ID NO: 734694 - DNA, 25 bp, Artificial sequence
  Synthetic oligonucleotide
tttaatacgttaatggttatgagtt

SEQ ID NO: 734695 - DNA, 25 bp, Artificial sequence
  Synthetic oligonucleotide
ctatcataagtcgattattaatgtt

SEQ ID NO: 734696 - DNA, 25 bp, Artificial sequence
  Synthetic oligonucleotide
ctatcataagtccattattaatgtt

SEQ ID NO: 734697 - DNA, 25 bp, Artificial sequence
  Synthetic oligonucleotide
tttctatcgactttttatcaagatt

SEQ ID NO: 734698 - DNA, 25 bp, Artificial sequence
  Synthetic oligonucleotide
tttctatcgactatttatcaagatt

SEQ ID NO: 734699 - DNA, 25 bp, Artificial sequence
  Synthetic oligonucleotide
ctaacagttgatggaatttaataat

SEQ ID NO: 734700 - DNA, 25 bp, Artificial sequence
  Synthetic oligonucleotide
gttttagattaatcgtataattctg

SEQ ID NO: 734701 - DNA, 25 bp, Artificial sequence
  Synthetic oligonucleotide
tatatctaaattacgtacaagcaaa

SEQ ID NO: 734702 - DNA, 25 bp, Artificial sequence
  Synthetic oligonucleotide
tgaataaacattaacgaactacaaa

SEQ ID NO: 734703 - DNA, 25 bp, Artificial sequence
  Synthetic oligonucleotide
aatagtatcgcaaaaactataacat

SEQ ID NO: 734704 - DNA, 25 bp, Artificial sequence
  Synthetic oligonucleotide
aagaaatcgacttatgttgaaataa

SEQ ID NO: 734705 - DNA, 25 bp, Artificial sequence
  Synthetic oligonucleotide
aagaaatcgactaatgttgaaataa

SEQ ID NO: 734706 - DNA, 25 bp, Artificial sequence
  Synthetic oligonucleotide
tatttttcaattatatatcgcagtc

SEQ ID NO: 734707 - DNA, 25 bp, Artificial sequence
  Synthetic oligonucleotide
tatttttcaattttatatcgcagtc

SEQ ID NO: 734708 - DNA, 25 bp, Artificial sequence
  Synthetic oligonucleotide
ctaaatcgctaatttatgtaaatca

SEQ ID NO: 734709 - DNA, 25 bp, Artificial sequence
  Synthetic oligonucleotide
aaaacttcgtaaaattatacctgaa

SEQ ID NO: 734710 - DNA, 25 bp, Artificial sequence
  Synthetic oligonucleotide
tatatctaaatttcgtacaagcaaa

SEQ ID NO: 734711 - DNA, 25 bp, Artificial sequence
  Synthetic oligonucleotide
aaaacttcgtaatattatacctgaa

SEQ ID NO: 734712 - DNA, 25 bp, Artificial sequence
  Synthetic oligonucleotide
tatataacattacgcttatgatatc

SEQ ID NO: 734713 - DNA, 25 bp, Artificial sequence
  Synthetic oligonucleotide
tatataacattaggcttatgatatc

SEQ ID NO: 734714 - DNA, 25 bp, Artificial sequence
  Synthetic oligonucleotide
atgtatatatcgacactattgatta

SEQ ID NO: 734715 - DNA, 25 bp, Artificial sequence
  Synthetic oligonucleotide
atgtatatatcgtcactattgatta

SEQ ID NO: 734716 - DNA, 25 bp, Artificial sequence
  Synthetic oligonucleotide
tgatatctaattattaatcgtgcat

SEQ ID NO: 734717 - DNA, 25 bp, Artificial sequence
  Synthetic oligonucleotide
tgatatctaatttttaatcgtgcat

SEQ ID NO: 734718 - DNA, 25 bp, Artificial sequence
  Synthetic oligonucleotide
acaactaaattattttacgctatga

SEQ ID NO: 734719 - DNA, 25 bp, Artificial sequence
  Synthetic oligonucleotide
acaactaaattaatttacgctatga

SEQ ID NO: 734720 - DNA, 25 bp, Artificial sequence
  Synthetic oligonucleotide
attgaatcttaatcgaatatgttgt

SEQ ID NO: 734721 - DNA, 25 bp, Artificial sequence
  Synthetic oligonucleotide
tttgacgttgatttcgatttttaaa

SEQ ID NO: 734722 - DNA, 25 bp, Artificial sequence
  Synthetic oligonucleotide
tttatttgtaattcgatccacaata

SEQ ID NO: 734723 - DNA, 25 bp, Artificial sequence
  Synthetic oligonucleotide
attgaatcttaaacgaatatgttgt

SEQ ID NO: 734724 - DNA, 25 bp, Artificial sequence
  Synthetic oligonucleotide
tattctatttatttcgatcgaaact

SEQ ID NO: 734725 - DNA, 25 bp, Artificial sequence
  Synthetic oligonucleotide
tattctatttatatcgatcgaaact

SEQ ID NO: 734726 - DNA, 25 bp, Artificial sequence
  Synthetic oligonucleotide
cagattataaatgcgttaattacat

SEQ ID NO: 734727 - DNA, 25 bp, Artificial sequence
  Synthetic oligonucleotide
cagattataaatccgttaattacat

SEQ ID NO: 734728 - DNA, 25 bp, Artificial sequence
  Synthetic oligonucleotide
ttacgatatcgaataaaggttttta

SEQ ID NO: 734729 - DNA, 25 bp, Artificial sequence
  Synthetic oligonucleotide
aatagtatcgcataaactataacat

SEQ ID NO: 734730 - DNA, 25 bp, Artificial sequence
  Synthetic oligonucleotide
tttgacgttgatatcgatttttaaa

SEQ ID NO: 734731 - DNA, 25 bp, Artificial sequence
  Synthetic oligonucleotide
atgaatgttattttactacgtcaat

SEQ ID NO: 734732 - DNA, 25 bp, Artificial sequence
  Synthetic oligonucleotide
tctacttactaatgaacgtaaaata

SEQ ID NO: 734733 - DNA, 25 bp, Artificial sequence
  Synthetic oligonucleotide
tctacttactaaagaacgtaaaata

SEQ ID NO: 734734 - DNA, 25 bp, Artificial sequence
  Synthetic oligonucleotide
ggatattatatttacgttagtctta

SEQ ID NO: 734735 - DNA, 25 bp, Artificial sequence
  Synthetic oligonucleotide
ggatattatattaacgttagtctta

SEQ ID NO: 734736 - DNA, 25 bp, Artificial sequence
  Synthetic oligonucleotide
tgagttatagtccaatttttcttat

SEQ ID NO: 734737 - DNA, 25 bp, Artificial sequence
  Synthetic oligonucleotide
atgaatgttattatactacgtcaat

SEQ ID NO: 734738 - DNA, 25 bp, Artificial sequence
  Synthetic oligonucleotide
gatagttatatgcgatttattactt

SEQ ID NO: 734739 - DNA, 25 bp, Artificial sequence
  Synthetic oligonucleotide
gatagttatatgggatttattactt

SEQ ID NO: 734740 - DNA, 25 bp, Artificial sequence
  Synthetic oligonucleotide
ttacgatatcgattaaaggttttta

SEQ ID NO: 734741 - DNA, 25 bp, Artificial sequence
  Synthetic oligonucleotide
gatttttaactttttcgaattcgat

SEQ ID NO: 734742 - DNA, 25 bp, Artificial sequence
  Synthetic oligonucleotide
agaatttatgcgtaatttatcctaa

SEQ ID NO: 734743 - DNA, 25 bp, Artificial sequence
  Synthetic oligonucleotide
aacagtattcacgatataattagtt

SEQ ID NO: 734744 - DNA, 25 bp, Artificial sequence
  Synthetic oligonucleotide
aacagtattcaccatataattagtt

SEQ ID NO: 734745 - DNA, 25 bp, Artificial sequence
  Synthetic oligonucleotide
agcaacgcataaaaattcattaaaa

SEQ ID NO: 734746 - DNA, 25 bp, Artificial sequence
  Synthetic oligonucleotide
agcaacgcataataattcattaaaa

SEQ ID NO: 734747 - DNA, 25 bp, Artificial sequence
  Synthetic oligonucleotide
aaacatgattagtacgaaatgaata

SEQ ID NO: 734748 - DNA, 25 bp, Artificial sequence
  Synthetic oligonucleotide
aaacatgattagaacgaaatgaata

SEQ ID NO: 734749 - DNA, 25 bp, Artificial sequence
  Synthetic oligonucleotide
agaatttatgcgaaatttatcctaa

SEQ ID NO: 734750 - DNA, 25 bp, Artificial sequence
  Synthetic oligonucleotide
tctattatgatatcgtattactagt

SEQ ID NO: 734751 - DNA, 25 bp, Artificial sequence
  Synthetic oligonucleotide
atgctattttttttacgcgaattat

SEQ ID NO: 734752 - DNA, 25 bp, Artificial sequence
  Synthetic oligonucleotide
gatttttaacttattcgaattcgat

SEQ ID NO: 734753 - DNA, 25 bp, Artificial sequence
  Synthetic oligonucleotide
aaatatcgttaatataatcctgaga

SEQ ID NO: 734754 - DNA, 25 bp, Artificial sequence
  Synthetic oligonucleotide
aaatatcgttaaaataatcctgaga

SEQ ID NO: 734755 - DNA, 25 bp, Artificial sequence
  Synthetic oligonucleotide
attaaaatattatcgaaacgacaag

SEQ ID NO: 734756 - DNA, 25 bp, Artificial sequence
  Synthetic oligonucleotide
tgaataaacatttacgaactacaaa

SEQ ID NO: 734757 - DNA, 25 bp, Artificial sequence
  Synthetic oligonucleotide
tgagttatagtcgaatttttcttat

SEQ ID NO: 734758 - DNA, 25 bp, Artificial sequence
  Synthetic oligonucleotide
tttatttgtaatacgatccacaata

SEQ ID NO: 734759 - DNA, 25 bp, Artificial sequence
  Synthetic oligonucleotide
attaaaatattaacgaaacgacaag

SEQ ID NO: 734760 - DNA, 25 bp, Artificial sequence
  Synthetic oligonucleotide
atgctattttttatacgcgaattat

SEQ ID NO: 734761 - DNA, 25 bp, Artificial sequence
  Synthetic oligonucleotide
aaaagtatttcaagcgattatttgt

SEQ ID NO: 734762 - DNA, 25 bp, Artificial sequence
  Synthetic oligonucleotide
gttatgtaatataatgcgatgataa

SEQ ID NO: 734763 - DNA, 25 bp, Artificial sequence
  Synthetic oligonucleotide
aattagttacgatatgattaatggt

SEQ ID NO: 734764 - DNA, 25 bp, Artificial sequence
  Synthetic oligonucleotide
aattagttacgaaatgattaatggt

SEQ ID NO: 734765 - DNA, 25 bp, Artificial sequence
  Synthetic oligonucleotide
tctattatgataacgtattactagt

SEQ ID NO: 734766 - DNA, 25 bp, Artificial sequence
  Synthetic oligonucleotide
tacttcatattactacgtcttaaat

SEQ ID NO: 734767 - DNA, 25 bp, Artificial sequence
  Synthetic oligonucleotide
atatataattaccaaattggctatc

SEQ ID NO: 734768 - DNA, 25 bp, Artificial sequence
  Synthetic oligonucleotide
atatataattacgaaattggctatc

SEQ ID NO: 734769 - DNA, 25 bp, Artificial sequence
  Synthetic oligonucleotide
gttatgtaatattatgcgatgataa

SEQ ID NO: 734770 - DNA, 25 bp, Artificial sequence
  Synthetic oligonucleotide
gagaaaatcgtattaagttattctt

SEQ ID NO: 734771 - DNA, 25 bp, Artificial sequence
  Synthetic oligonucleotide
aaaagtatttcatgcgattatttgt

SEQ ID NO: 734772 - DNA, 25 bp, Artificial sequence
  Synthetic oligonucleotide
ctttcaattataattagcgtatatg

SEQ ID NO: 734773 - DNA, 25 bp, Artificial sequence
  Synthetic oligonucleotide
ttagtataatagtatcgttaacttg

SEQ ID NO: 734774 - DNA, 25 bp, Artificial sequence
  Synthetic oligonucleotide
ctttcaattatatttagcgtatatg

SEQ ID NO: 734775 - DNA, 25 bp, Artificial sequence
  Synthetic oligonucleotide
tacttcatattagtacgtcttaaat

SEQ ID NO: 734776 - DNA, 25 bp, Artificial sequence
  Synthetic oligonucleotide
acttattaactttttacgatttgtc

SEQ ID NO: 734777 - DNA, 25 bp, Artificial sequence
  Synthetic oligonucleotide
acttattaacttattacgatttgtc

SEQ ID NO: 734778 - DNA, 25 bp, Artificial sequence
  Synthetic oligonucleotide
ttagtataatagaatcgttaacttg

SEQ ID NO: 734779 - DNA, 25 bp, Artificial sequence
  Synthetic oligonucleotide
ataatacaataaattagcgataggt

SEQ ID NO: 734780 - DNA, 25 bp, Artificial sequence
  Synthetic oligonucleotide
gagaaaatcgtaataagttattctt

SEQ ID NO: 734781 - DNA, 25 bp, Artificial sequence
  Synthetic oligonucleotide
ataatacaataatttagcgataggt

SEQ ID NO: 734782 - DNA, 25 bp, Artificial sequence
  Synthetic oligonucleotide
atcgtaattaagcgaattgtcaaaa

SEQ ID NO: 734783 - DNA, 25 bp, Artificial sequence
  Synthetic oligonucleotide
atcgtaattaagggaattgtcaaaa

SEQ ID NO: 734784 - DNA, 25 bp, Artificial sequence
  Synthetic oligonucleotide
aagagttagaacggaaagatatata

SEQ ID NO: 734785 - DNA, 25 bp, Artificial sequence
  Synthetic oligonucleotide
aagagttagaaccgaaagatatata

SEQ ID NO: 734786 - DNA, 25 bp, Artificial sequence
  Synthetic oligonucleotide
acggaatcgactattatattttttc

SEQ ID NO: 734787 - DNA, 25 bp, Artificial sequence
  Synthetic oligonucleotide
ttgtagaaaattgacgatcttctat

SEQ ID NO: 734788 - DNA, 25 bp, Artificial sequence
  Synthetic oligonucleotide
acggaatcgacttttatattttttc

SEQ ID NO: 734789 - DNA, 25 bp, Artificial sequence
  Synthetic oligonucleotide
caaaacgttaacatatactatactc

SEQ ID NO: 734790 - DNA, 25 bp, Artificial sequence
  Synthetic oligonucleotide
ataattacgcaccttttaatgtcta

SEQ ID NO: 734791 - DNA, 25 bp, Artificial sequence
  Synthetic oligonucleotide
ttgtagaaaattcacgatcttctat

SEQ ID NO: 734792 - DNA, 25 bp, Artificial sequence
  Synthetic oligonucleotide
caaaacgttaacttatactatactc

SEQ ID NO: 734793 - DNA, 25 bp, Artificial sequence
  Synthetic oligonucleotide
ttggacaatattacgtagtaattag

SEQ ID NO: 734794 - DNA, 25 bp, Artificial sequence
  Synthetic oligonucleotide
ttggacaatatttcgtagtaattag

SEQ ID NO: 734795 - DNA, 25 bp, Artificial sequence
  Synthetic oligonucleotide
gtctagtgattaggtattaaactat

SEQ ID NO: 734796 - DNA, 25 bp, Artificial sequence
  Synthetic oligonucleotide
gtctagtgattacgtattaaactat

SEQ ID NO: 734797 - DNA, 25 bp, Artificial sequence
  Synthetic oligonucleotide
agatacgtataagtttaatacagag

SEQ ID NO: 734798 - DNA, 25 bp, Artificial sequence
  Synthetic oligonucleotide
ataattacgcacgttttaatgtcta

SEQ ID NO: 734799 - DNA, 25 bp, Artificial sequence
  Synthetic oligonucleotide
gcaaaaattatttcgacatatacct

SEQ ID NO: 734800 - DNA, 25 bp, Artificial sequence
  Synthetic oligonucleotide
acatagatatcgtaataagtcgtat

SEQ ID NO: 734801 - DNA, 25 bp, Artificial sequence
  Synthetic oligonucleotide
atattatctttttcgatcgactgta

SEQ ID NO: 734802 - DNA, 25 bp, Artificial sequence
  Synthetic oligonucleotide
gcaaaaattattacgacatatacct

SEQ ID NO: 734803 - DNA, 25 bp, Artificial sequence
  Synthetic oligonucleotide
gaatacgcctataatattaaaggtt

SEQ ID NO: 734804 - DNA, 25 bp, Artificial sequence
  Synthetic oligonucleotide
agatacgtataactttaatacagag

SEQ ID NO: 734805 - DNA, 25 bp, Artificial sequence
  Synthetic oligonucleotide
cacaataatatgaaccgacattaaa

SEQ ID NO: 734806 - DNA, 25 bp, Artificial sequence
  Synthetic oligonucleotide
actgtagttattcggatgaaattta

SEQ ID NO: 734807 - DNA, 25 bp, Artificial sequence
  Synthetic oligonucleotide
gaatacgcctattatattaaaggtt

SEQ ID NO: 734808 - DNA, 25 bp, Artificial sequence
  Synthetic oligonucleotide
gaacttatcgcgatttatttttatc

SEQ ID NO: 734809 - DNA, 25 bp, Artificial sequence
  Synthetic oligonucleotide
gaacttatcgcgttttatttttatc

SEQ ID NO: 734810 - DNA, 25 bp, Artificial sequence
  Synthetic oligonucleotide
tgtcatacgaattaaagattttcac

SEQ ID NO: 734811 - DNA, 25 bp, Artificial sequence
  Synthetic oligonucleotide
tgtcatacgaataaaagattttcac

SEQ ID NO: 734812 - DNA, 25 bp, Artificial sequence
  Synthetic oligonucleotide
atattatcttttacgatcgactgta

SEQ ID NO: 734813 - DNA, 25 bp, Artificial sequence
  Synthetic oligonucleotide
gtaaatagtcaagattcgaagtatt

SEQ ID NO: 734814 - DNA, 25 bp, Artificial sequence
  Synthetic oligonucleotide
ttctatagataagacacgtttagat

SEQ ID NO: 734815 - DNA, 25 bp, Artificial sequence
  Synthetic oligonucleotide
ttctatagataacacacgtttagat

SEQ ID NO: 734816 - DNA, 25 bp, Artificial sequence
  Synthetic oligonucleotide
gtaaatagtcaacattcgaagtatt

SEQ ID NO: 734817 - DNA, 25 bp, Artificial sequence
  Synthetic oligonucleotide
tactaacgatttgagtatattcaag

SEQ ID NO: 734818 - DNA, 25 bp, Artificial sequence
  Synthetic oligonucleotide
acatagatatcgaaataagtcgtat

SEQ ID NO: 734819 - DNA, 25 bp, Artificial sequence
  Synthetic oligonucleotide
cacaataatatgtaccgacattaaa

SEQ ID NO: 734820 - DNA, 25 bp, Artificial sequence
  Synthetic oligonucleotide
gataacaattttcgactgtttaaga

SEQ ID NO: 734821 - DNA, 25 bp, Artificial sequence
  Synthetic oligonucleotide
gataacaattttggactgtttaaga

SEQ ID NO: 734822 - DNA, 25 bp, Artificial sequence
  Synthetic oligonucleotide
ataatttaattactcgtcttcaagc

SEQ ID NO: 734823 - DNA, 25 bp, Artificial sequence
  Synthetic oligonucleotide
ataatttaattagtcgtcttcaagc

SEQ ID NO: 734824 - DNA, 25 bp, Artificial sequence
  Synthetic oligonucleotide
gtatcacttcttttcggtataaata

SEQ ID NO: 734825 - DNA, 25 bp, Artificial sequence
  Synthetic oligonucleotide
gtatcacttcttatcggtataaata

SEQ ID NO: 734826 - DNA, 25 bp, Artificial sequence
  Synthetic oligonucleotide
tagtaagttaacgctaaataatagg

SEQ ID NO: 734827 - DNA, 25 bp, Artificial sequence
  Synthetic oligonucleotide
tagtaagttaaccctaaataatagg

SEQ ID NO: 734828 - DNA, 25 bp, Artificial sequence
  Synthetic oligonucleotide
gcaattttatacgactattgtagtt

SEQ ID NO: 734829 - DNA, 25 bp, Artificial sequence
  Synthetic oligonucleotide
gcaattttataccactattgtagtt

SEQ ID NO: 734830 - DNA, 25 bp, Artificial sequence
  Synthetic oligonucleotide
tactaacgatttcagtatattcaag

SEQ ID NO: 734831 - DNA, 25 bp, Artificial sequence
  Synthetic oligonucleotide
actgtagttattgggatgaaattta

SEQ ID NO: 734832 - DNA, 25 bp, Artificial sequence
  Synthetic oligonucleotide
ctatttacggtttttataacgatct

SEQ ID NO: 734833 - DNA, 25 bp, Artificial sequence
  Synthetic oligonucleotide
aatcatattataacgagtaagtgac

SEQ ID NO: 734834 - DNA, 25 bp, Artificial sequence
  Synthetic oligonucleotide
cagaatatcgtattggaatttaatc

SEQ ID NO: 734835 - DNA, 25 bp, Artificial sequence
  Synthetic oligonucleotide
cagaatatcgtaatggaatttaatc

SEQ ID NO: 734836 - DNA, 25 bp, Artificial sequence
  Synthetic oligonucleotide
tgctacgataataactaatcaaaca

SEQ ID NO: 734837 - DNA, 25 bp, Artificial sequence
  Synthetic oligonucleotide
tgctacgataattactaatcaaaca

SEQ ID NO: 734838 - DNA, 25 bp, Artificial sequence
  Synthetic oligonucleotide
attatacgcgaaatacaatacctat

SEQ ID NO: 734839 - DNA, 25 bp, Artificial sequence
  Synthetic oligonucleotide
attatacgcgaattacaatacctat

SEQ ID NO: 734840 - DNA, 25 bp, Artificial sequence
  Synthetic oligonucleotide
caaatttatgcgaattaatagtggt

SEQ ID NO: 734841 - DNA, 25 bp, Artificial sequence
  Synthetic oligonucleotide
caaatttatgcgtattaatagtggt

SEQ ID NO: 734842 - DNA, 25 bp, Artificial sequence
  Synthetic oligonucleotide
agataaatcgattaactatattcgg

SEQ ID NO: 734843 - DNA, 25 bp, Artificial sequence
  Synthetic oligonucleotide
aatccttaaacaattgtcgctaata

SEQ ID NO: 734844 - DNA, 25 bp, Artificial sequence
  Synthetic oligonucleotide
agataaatcgataaactatattcgg

SEQ ID NO: 734845 - DNA, 25 bp, Artificial sequence
  Synthetic oligonucleotide
atcgattagatacttcgtaaactaa

SEQ ID NO: 734846 - DNA, 25 bp, Artificial sequence
  Synthetic oligonucleotide
ctgtaaatcgttattcaatattctg

SEQ ID NO: 734847 - DNA, 25 bp, Artificial sequence
  Synthetic oligonucleotide
ctgtaaatcgtttttcaatattctg

SEQ ID NO: 734848 - DNA, 25 bp, Artificial sequence
  Synthetic oligonucleotide
gtatgtaatttatctacgatcagat

SEQ ID NO: 734849 - DNA, 25 bp, Artificial sequence
  Synthetic oligonucleotide
gtatgtaatttaactacgatcagat

SEQ ID NO: 734850 - DNA, 25 bp, Artificial sequence
  Synthetic oligonucleotide
tgatatattattacgtcgaagatga

SEQ ID NO: 734851 - DNA, 25 bp, Artificial sequence
  Synthetic oligonucleotide
tgatatattatttcgtcgaagatga

SEQ ID NO: 734852 - DNA, 25 bp, Artificial sequence
  Synthetic oligonucleotide
tcgaggaatacgatacaataattta

SEQ ID NO: 734853 - DNA, 25 bp, Artificial sequence
  Synthetic oligonucleotide
tcgaggaatacgttacaataattta

SEQ ID NO: 734854 - DNA, 25 bp, Artificial sequence
  Synthetic oligonucleotide
ttagatcgtataaacgaaatccata

SEQ ID NO: 734855 - DNA, 25 bp, Artificial sequence
  Synthetic oligonucleotide
ctatttacggttattataacgatct

SEQ ID NO: 734856 - DNA, 25 bp, Artificial sequence
  Synthetic oligonucleotide
atttgtttcgtcgatttttaagaga

SEQ ID NO: 734857 - DNA, 25 bp, Artificial sequence
  Synthetic oligonucleotide
tgcgaataagtcctattatatttct

SEQ ID NO: 734858 - DNA, 25 bp, Artificial sequence
  Synthetic oligonucleotide
tgttctaacgctttgataatatgat

SEQ ID NO: 734859 - DNA, 25 bp, Artificial sequence
  Synthetic oligonucleotide
tgttctaacgctatgataatatgat

SEQ ID NO: 734860 - DNA, 25 bp, Artificial sequence
  Synthetic oligonucleotide
ttatacgttataaatataagctggg

SEQ ID NO: 734861 - DNA, 25 bp, Artificial sequence
  Synthetic oligonucleotide
ttatacgttatatatataagctggg

SEQ ID NO: 734862 - DNA, 25 bp, Artificial sequence
  Synthetic oligonucleotide
tagaataatttactttacgaccaac

SEQ ID NO: 734863 - DNA, 25 bp, Artificial sequence
  Synthetic oligonucleotide
tagaataatttagtttacgaccaac

SEQ ID NO: 734864 - DNA, 25 bp, Artificial sequence
  Synthetic oligonucleotide
tctttaatttaaacgaacgcgttta

SEQ ID NO: 734865 - DNA, 25 bp, Artificial sequence
  Synthetic oligonucleotide
tctttaatttaatcgaacgcgttta

SEQ ID NO: 734866 - DNA, 25 bp, Artificial sequence
  Synthetic oligonucleotide
caatgatagaatttatccgatcata

SEQ ID NO: 734867 - DNA, 25 bp, Artificial sequence
  Synthetic oligonucleotide
aatcatattatatcgagtaagtgac

SEQ ID NO: 734868 - DNA, 25 bp, Artificial sequence
  Synthetic oligonucleotide
atttgtttcgtccatttttaagaga

SEQ ID NO: 734869 - DNA, 25 bp, Artificial sequence
  Synthetic oligonucleotide
tgcgaataagtcgtattatatttct

SEQ ID NO: 734870 - DNA, 25 bp, Artificial sequence
  Synthetic oligonucleotide
tctaatcatatttcgataatccatg

SEQ ID NO: 734871 - DNA, 25 bp, Artificial sequence
  Synthetic oligonucleotide
tctaatcatattacgataatccatg

SEQ ID NO: 734872 - DNA, 25 bp, Artificial sequence
  Synthetic oligonucleotide
aataagtatataatcgaacggagtt

SEQ ID NO: 734873 - DNA, 25 bp, Artificial sequence
  Synthetic oligonucleotide
aataagtatatattcgaacggagtt

SEQ ID NO: 734874 - DNA, 25 bp, Artificial sequence
  Synthetic oligonucleotide
acagaaaagttcctaatatgagaat

SEQ ID NO: 734875 - DNA, 25 bp, Artificial sequence
  Synthetic oligonucleotide
acagaaaagttcgtaatatgagaat

SEQ ID NO: 734876 - DNA, 25 bp, Artificial sequence
  Synthetic oligonucleotide
gcttgtacgaaaaaatactatagaa

SEQ ID NO: 734877 - DNA, 25 bp, Artificial sequence
  Synthetic oligonucleotide
gcttgtacgaaataatactatagaa

SEQ ID NO: 734878 - DNA, 25 bp, Artificial sequence
  Synthetic oligonucleotide
tacaaagtgttatcgctaattaaac

SEQ ID NO: 734879 - DNA, 25 bp, Artificial sequence
  Synthetic oligonucleotide
tacaaagtgttaacgctaattaaac

SEQ ID NO: 734880 - DNA, 25 bp, Artificial sequence
  Synthetic oligonucleotide
caatgatagaatatatccgatcata

SEQ ID NO: 734881 - DNA, 25 bp, Artificial sequence
  Synthetic oligonucleotide
tactgcttgcatggatataaaaaat

SEQ ID NO: 734882 - DNA, 25 bp, Artificial sequence
  Synthetic oligonucleotide
tcatatagatgaatatcgaaacatg

SEQ ID NO: 734883 - DNA, 25 bp, Artificial sequence
  Synthetic oligonucleotide
aatcaattcgtttgttgaacaactt

SEQ ID NO: 734884 - DNA, 25 bp, Artificial sequence
  Synthetic oligonucleotide
aatcaattcgttagttgaacaactt

SEQ ID NO: 734885 - DNA, 25 bp, Artificial sequence
  Synthetic oligonucleotide
cacagatattcgttatgatataact

SEQ ID NO: 734886 - DNA, 25 bp, Artificial sequence
  Synthetic oligonucleotide
cacagatattcgatatgatataact

SEQ ID NO: 734887 - DNA, 25 bp, Artificial sequence
  Synthetic oligonucleotide
ttgaataacgacaatgaattatgac

SEQ ID NO: 734888 - DNA, 25 bp, Artificial sequence
  Synthetic oligonucleotide
ttgaataacgactatgaattatgac

SEQ ID NO: 734889 - DNA, 25 bp, Artificial sequence
  Synthetic oligonucleotide
ctatctcgaactttagtaaaattac

SEQ ID NO: 734890 - DNA, 25 bp, Artificial sequence
  Synthetic oligonucleotide
ctatctcgaactatagtaaaattac

SEQ ID NO: 734891 - DNA, 25 bp, Artificial sequence
  Synthetic oligonucleotide
taatttcgttagtctcaattagaag

SEQ ID NO: 734892 - DNA, 25 bp, Artificial sequence
  Synthetic oligonucleotide
atagtacgactaaatatcttaatcc

SEQ ID NO: 734893 - DNA, 25 bp, Artificial sequence
  Synthetic oligonucleotide
caacatcggtaactttatatagaat

SEQ ID NO: 734894 - DNA, 25 bp, Artificial sequence
  Synthetic oligonucleotide
aactatatcgtaagctacaacattt

SEQ ID NO: 734895 - DNA, 25 bp, Artificial sequence
  Synthetic oligonucleotide
ctcaataaggttcttatcgataaaa

SEQ ID NO: 734896 - DNA, 25 bp, Artificial sequence
  Synthetic oligonucleotide
ctcaataaggttgttatcgataaaa

SEQ ID NO: 734897 - DNA, 25 bp, Artificial sequence
  Synthetic oligonucleotide
aattactagaaataccgtatgctaa

SEQ ID NO: 734898 - DNA, 25 bp, Artificial sequence
  Synthetic oligonucleotide
aattactagaaaaaccgtatgctaa

SEQ ID NO: 734899 - DNA, 25 bp, Artificial sequence
  Synthetic oligonucleotide
aatatagtatagttagtcgaaaacg

SEQ ID NO: 734900 - DNA, 25 bp, Artificial sequence
  Synthetic oligonucleotide
aatatagtatagatagtcgaaaacg

SEQ ID NO: 734901 - DNA, 25 bp, Artificial sequence
  Synthetic oligonucleotide
tgtagtattatagttaacgcaatca

SEQ ID NO: 734902 - DNA, 25 bp, Artificial sequence
  Synthetic oligonucleotide
tgtagtattatacttaacgcaatca

SEQ ID NO: 734903 - DNA, 25 bp, Artificial sequence
  Synthetic oligonucleotide
atttacaatgatttcgtatactctc

SEQ ID NO: 734904 - DNA, 25 bp, Artificial sequence
  Synthetic oligonucleotide
tcaatcttaatcctaacgtattaga

SEQ ID NO: 734905 - DNA, 25 bp, Artificial sequence
  Synthetic oligonucleotide
taatttcgttagactcaattagaag

SEQ ID NO: 734906 - DNA, 25 bp, Artificial sequence
  Synthetic oligonucleotide
taagaagtcttattagatcgattac

SEQ ID NO: 734907 - DNA, 25 bp, Artificial sequence
  Synthetic oligonucleotide
actttctattgttcgtcaaagaata

SEQ ID NO: 734908 - DNA, 25 bp, Artificial sequence
  Synthetic oligonucleotide
actttctattgtacgtcaaagaata

SEQ ID NO: 734909 - DNA, 25 bp, Artificial sequence
  Synthetic oligonucleotide
acatacgactaatcagttattaagt

SEQ ID NO: 734910 - DNA, 25 bp, Artificial sequence
  Synthetic oligonucleotide
acatacgactaaacagttattaagt

SEQ ID NO: 734911 - DNA, 25 bp, Artificial sequence
  Synthetic oligonucleotide
tcattcggaattttttgacttattg

SEQ ID NO: 734912 - DNA, 25 bp, Artificial sequence
  Synthetic oligonucleotide
tcattcggaattatttgacttattg

SEQ ID NO: 734913 - DNA, 25 bp, Artificial sequence
  Synthetic oligonucleotide
aagtatattatactatatcgccctt

SEQ ID NO: 734914 - DNA, 25 bp, Artificial sequence
  Synthetic oligonucleotide
aagtatattatagtatatcgccctt

SEQ ID NO: 734915 - DNA, 25 bp, Artificial sequence
  Synthetic oligonucleotide
gtctcctaaatttatcgaaaacaat

SEQ ID NO: 734916 - DNA, 25 bp, Artificial sequence
  Synthetic oligonucleotide
gtctcctaaattaatcgaaaacaat

SEQ ID NO: 734917 - DNA, 25 bp, Artificial sequence
  Synthetic oligonucleotide
atagtacgactatatatcttaatcc

SEQ ID NO: 734918 - DNA, 25 bp, Artificial sequence
  Synthetic oligonucleotide
tcgtggataactttatcgattttta

SEQ ID NO: 734919 - DNA, 25 bp, Artificial sequence
  Synthetic oligonucleotide
tcatatagatgattatcgaaacatg

SEQ ID NO: 734920 - DNA, 25 bp, Artificial sequence
  Synthetic oligonucleotide
taagaagtcttaatagatcgattac

SEQ ID NO: 734921 - DNA, 25 bp, Artificial sequence
  Synthetic oligonucleotide
gattgacgttaaagtgatattttac

SEQ ID NO: 734922 - DNA, 25 bp, Artificial sequence
  Synthetic oligonucleotide
gattgacgttaatgtgatattttac

SEQ ID NO: 734923 - DNA, 25 bp, Artificial sequence
  Synthetic oligonucleotide
ctaatttttacgaaacgcatatgat

SEQ ID NO: 734924 - DNA, 25 bp, Artificial sequence
  Synthetic oligonucleotide
ctaatttttacgtaacgcatatgat

SEQ ID NO: 734925 - DNA, 25 bp, Artificial sequence
  Synthetic oligonucleotide
aagaggatggcgaaatattattata

SEQ ID NO: 734926 - DNA, 25 bp, Artificial sequence
  Synthetic oligonucleotide
aagaggatggcgtaatattattata

SEQ ID NO: 734927 - DNA, 25 bp, Artificial sequence
  Synthetic oligonucleotide
aagggcatacgttatataagaaatt

SEQ ID NO: 734928 - DNA, 25 bp, Artificial sequence
  Synthetic oligonucleotide
aagggcatacgtaatataagaaatt

SEQ ID NO: 734929 - DNA, 25 bp, Artificial sequence
  Synthetic oligonucleotide
aactatatcgtatgctacaacattt

SEQ ID NO: 734930 - DNA, 25 bp, Artificial sequence
  Synthetic oligonucleotide
tcgtggataactatatcgattttta

SEQ ID NO: 734931 - DNA, 25 bp, Artificial sequence
  Synthetic oligonucleotide
taaacatatattccgtagacttaca

SEQ ID NO: 734932 - DNA, 25 bp, Artificial sequence
  Synthetic oligonucleotide
atttacaatgatatcgtatactctc

SEQ ID NO: 734933 - DNA, 25 bp, Artificial sequence
  Synthetic oligonucleotide
atcaagcgtattatgatagaacaat

SEQ ID NO: 734934 - DNA, 25 bp, Artificial sequence
  Synthetic oligonucleotide
atcaagcgtattttgatagaacaat

SEQ ID NO: 734935 - DNA, 25 bp, Artificial sequence
  Synthetic oligonucleotide
atagatactattaatcgatcgaaca

SEQ ID NO: 734936 - DNA, 25 bp, Artificial sequence
  Synthetic oligonucleotide
atagatactatttatcgatcgaaca

SEQ ID NO: 734937 - DNA, 25 bp, Artificial sequence
  Synthetic oligonucleotide
tccgttcgtactatataatgtaata

SEQ ID NO: 734938 - DNA, 25 bp, Artificial sequence
  Synthetic oligonucleotide
tccgttcgtactttataatgtaata

SEQ ID NO: 734939 - DNA, 25 bp, Artificial sequence
  Synthetic oligonucleotide
tagttatttaaccatcgaatattgc

SEQ ID NO: 734940 - DNA, 25 bp, Artificial sequence
  Synthetic oligonucleotide
tagttatttaacgatcgaatattgc

SEQ ID NO: 734941 - DNA, 25 bp, Artificial sequence
  Synthetic oligonucleotide
tctaagtaagcgtattattagtgaa

SEQ ID NO: 734942 - DNA, 25 bp, Artificial sequence
  Synthetic oligonucleotide
tcagcatcgaaaattttcgataatt

SEQ ID NO: 734943 - DNA, 25 bp, Artificial sequence
  Synthetic oligonucleotide
taaacatatattgcgtagacttaca

SEQ ID NO: 734944 - DNA, 25 bp, Artificial sequence
  Synthetic oligonucleotide
gattgaattgtgcgatatgaaaaaa

SEQ ID NO: 734945 - DNA, 25 bp, Artificial sequence
  Synthetic oligonucleotide
ttgataagcggttaatagtaatagt

SEQ ID NO: 734946 - DNA, 25 bp, Artificial sequence
  Synthetic oligonucleotide
ttgataagcggtaaatagtaatagt

SEQ ID NO: 734947 - DNA, 25 bp, Artificial sequence
  Synthetic oligonucleotide
tcgttacgcaatactcttattaata

SEQ ID NO: 734948 - DNA, 25 bp, Artificial sequence
  Synthetic oligonucleotide
tcgttacgcaattctcttattaata

SEQ ID NO: 734949 - DNA, 25 bp, Artificial sequence
  Synthetic oligonucleotide
aagagaaataccgtaattgcttata

SEQ ID NO: 734950 - DNA, 25 bp, Artificial sequence
  Synthetic oligonucleotide
aagagaaataccctaattgcttata

SEQ ID NO: 734951 - DNA, 25 bp, Artificial sequence
  Synthetic oligonucleotide
tcaattatcgaattttagcgtttgt

SEQ ID NO: 734952 - DNA, 25 bp, Artificial sequence
  Synthetic oligonucleotide
tcaattatcgaaatttagcgtttgt

SEQ ID NO: 734953 - DNA, 25 bp, Artificial sequence
  Synthetic oligonucleotide
agatttctcgaattttaccatattg

SEQ ID NO: 734954 - DNA, 25 bp, Artificial sequence
  Synthetic oligonucleotide
agatttctcgaaatttaccatattg

SEQ ID NO: 734955 - DNA, 25 bp, Artificial sequence
  Synthetic oligonucleotide
tctaagtaagcgaattattagtgaa

SEQ ID NO: 734956 - DNA, 25 bp, Artificial sequence
  Synthetic oligonucleotide
agagtatactaatcgtttaactttg

SEQ ID NO: 734957 - DNA, 25 bp, Artificial sequence
  Synthetic oligonucleotide
ttctaacggttaatttattgactgt

SEQ ID NO: 734958 - DNA, 25 bp, Artificial sequence
  Synthetic oligonucleotide
ttctaacggttattttattgactgt

SEQ ID NO: 734959 - DNA, 25 bp, Artificial sequence
  Synthetic oligonucleotide
aataaaaacgatatagttgctctac

SEQ ID NO: 734960 - DNA, 25 bp, Artificial sequence
  Synthetic oligonucleotide
aataaaaacgatttagttgctctac

SEQ ID NO: 734961 - DNA, 25 bp, Artificial sequence
  Synthetic oligonucleotide
tctaatagatagtacgcataacatt

SEQ ID NO: 734962 - DNA, 25 bp, Artificial sequence
  Synthetic oligonucleotide
tctaatagatagaacgcataacatt

SEQ ID NO: 734963 - DNA, 25 bp, Artificial sequence
  Synthetic oligonucleotide
atcgattagatagttcgtaaactaa

SEQ ID NO: 734964 - DNA, 25 bp, Artificial sequence
  Synthetic oligonucleotide
tactgcttgcatcgatataaaaaat

SEQ ID NO: 734965 - DNA, 25 bp, Artificial sequence
  Synthetic oligonucleotide
tcaatcttaatcgtaacgtattaga

SEQ ID NO: 734966 - DNA, 25 bp, Artificial sequence
  Synthetic oligonucleotide
ttagatcgtatatacgaaatccata

SEQ ID NO: 734967 - DNA, 25 bp, Artificial sequence
  Synthetic oligonucleotide
tcagcatcgaaatttttcgataatt

SEQ ID NO: 734968 - DNA, 25 bp, Artificial sequence
  Synthetic oligonucleotide
taaagtttttaaaacgtcgattctc

SEQ ID NO: 734969 - DNA, 25 bp, Artificial sequence
  Synthetic oligonucleotide
aatccttaaacatttgtcgctaata

SEQ ID NO: 734970 - DNA, 25 bp, Artificial sequence
  Synthetic oligonucleotide
agagtatactaaacgtttaactttg

SEQ ID NO: 734971 - DNA, 25 bp, Artificial sequence
  Synthetic oligonucleotide
tttatataaccaatatatcggaggt

SEQ ID NO: 734972 - DNA, 25 bp, Artificial sequence
  Synthetic oligonucleotide
tttatataaccattatatcggaggt

SEQ ID NO: 734973 - DNA, 25 bp, Artificial sequence
  Synthetic oligonucleotide
ctaagttataatagttagcgtttga

SEQ ID NO: 734974 - DNA, 25 bp, Artificial sequence
  Synthetic oligonucleotide
ctaagttataattgttagcgtttga

SEQ ID NO: 734975 - DNA, 25 bp, Artificial sequence
  Synthetic oligonucleotide
atataaactaattgcgtactttcga

SEQ ID NO: 734976 - DNA, 25 bp, Artificial sequence
  Synthetic oligonucleotide
atataaactaatagcgtactttcga

SEQ ID NO: 734977 - DNA, 25 bp, Artificial sequence
  Synthetic oligonucleotide
atttttactattagtacgatcatgc

SEQ ID NO: 734978 - DNA, 25 bp, Artificial sequence
  Synthetic oligonucleotide
atttttactatttgtacgatcatgc

SEQ ID NO: 734979 - DNA, 25 bp, Artificial sequence
  Synthetic oligonucleotide
gattgaattgtgggatatgaaaaaa

SEQ ID NO: 734980 - DNA, 25 bp, Artificial sequence
  Synthetic oligonucleotide
taaagtttttaatacgtcgattctc

SEQ ID NO: 734981 - DNA, 25 bp, Artificial sequence
  Synthetic oligonucleotide
tcaatatagatatttaaccgcagtt

SEQ ID NO: 734982 - DNA, 25 bp, Artificial sequence
  Synthetic oligonucleotide
atatctgttcgatatttatggatag

SEQ ID NO: 734983 - DNA, 25 bp, Artificial sequence
  Synthetic oligonucleotide
ttcattgcgtaatctatattttggt

SEQ ID NO: 734984 - DNA, 25 bp, Artificial sequence
  Synthetic oligonucleotide
ttcattgcgtaaactatattttggt

SEQ ID NO: 734985 - DNA, 25 bp, Artificial sequence
  Synthetic oligonucleotide
cgactatttagtacgtcatattaaa

SEQ ID NO: 734986 - DNA, 25 bp, Artificial sequence
  Synthetic oligonucleotide
cgactatttagttcgtcatattaaa

SEQ ID NO: 734987 - DNA, 25 bp, Artificial sequence
  Synthetic oligonucleotide
ttctacgatgaacatttctaaaact

SEQ ID NO: 734988 - DNA, 25 bp, Artificial sequence
  Synthetic oligonucleotide
ttctacgatgaagatttctaaaact

SEQ ID NO: 734989 - DNA, 25 bp, Artificial sequence
  Synthetic oligonucleotide
atcaatcgcgaaatttttactatac

SEQ ID NO: 734990 - DNA, 25 bp, Artificial sequence
  Synthetic oligonucleotide
atcaatcgcgaattttttactatac

SEQ ID NO: 734991 - DNA, 25 bp, Artificial sequence
  Synthetic oligonucleotide
tttgaattcgataaccgaaacaaat

SEQ ID NO: 734992 - DNA, 25 bp, Artificial sequence
  Synthetic oligonucleotide
tacttacgtttacgttatagatttg

SEQ ID NO: 734993 - DNA, 25 bp, Artificial sequence
  Synthetic oligonucleotide
tcaatatagataattaaccgcagtt

SEQ ID NO: 734994 - DNA, 25 bp, Artificial sequence
  Synthetic oligonucleotide
gactatttttcgtattgatccaaaa

SEQ ID NO: 734995 - DNA, 25 bp, Artificial sequence
  Synthetic oligonucleotide
gtaagcgataattattcgtaaaaga

SEQ ID NO: 734996 - DNA, 25 bp, Artificial sequence
  Synthetic oligonucleotide
gtaagcgataataattcgtaaaaga

SEQ ID NO: 734997 - DNA, 25 bp, Artificial sequence
  Synthetic oligonucleotide
aataattaacgtagcgcgataatat

SEQ ID NO: 734998 - DNA, 25 bp, Artificial sequence
  Synthetic oligonucleotide
aataattaacgttgcgcgataatat

SEQ ID NO: 734999 - DNA, 25 bp, Artificial sequence
  Synthetic oligonucleotide
aatatattaatacgcggacagattt

SEQ ID NO: 735000 - DNA, 25 bp, Artificial sequence
  Synthetic oligonucleotide
aatatattaataggcggacagattt

SEQ ID NO: 735001 - DNA, 25 bp, Artificial sequence
  Synthetic oligonucleotide
ttgtattccgtcgaactataaataa

SEQ ID NO: 735002 - DNA, 25 bp, Artificial sequence
  Synthetic oligonucleotide
ttgtattccgtccaactataaataa

SEQ ID NO: 735003 - DNA, 25 bp, Artificial sequence
  Synthetic oligonucleotide
ataggtattagcgcgatataattta

SEQ ID NO: 735004 - DNA, 25 bp, Artificial sequence
  Synthetic oligonucleotide
tattttatcataacgatacgcacat

SEQ ID NO: 735005 - DNA, 25 bp, Artificial sequence
  Synthetic oligonucleotide
tttgaattcgattaccgaaacaaat

SEQ ID NO: 735006 - DNA, 25 bp, Artificial sequence
  Synthetic oligonucleotide
cttcaagtacgtactaaatcattaa

SEQ ID NO: 735007 - DNA, 25 bp, Artificial sequence
  Synthetic oligonucleotide
tttagacaatataaatcgcttcaga

SEQ ID NO: 735008 - DNA, 25 bp, Artificial sequence
  Synthetic oligonucleotide
tttagacaatattaatcgcttcaga

SEQ ID NO: 735009 - DNA, 25 bp, Artificial sequence
  Synthetic oligonucleotide
taagtatacggtgtaaattatctct

SEQ ID NO: 735010 - DNA, 25 bp, Artificial sequence
  Synthetic oligonucleotide
taagtatacggtctaaattatctct

SEQ ID NO: 735011 - DNA, 25 bp, Artificial sequence
  Synthetic oligonucleotide
agtggatattacgattagtttatag

SEQ ID NO: 735012 - DNA, 25 bp, Artificial sequence
  Synthetic oligonucleotide
agtggatattaccattagtttatag

SEQ ID NO: 735013 - DNA, 25 bp, Artificial sequence
  Synthetic oligonucleotide
tctaagtataaaactcgaactgttt

SEQ ID NO: 735014 - DNA, 25 bp, Artificial sequence
  Synthetic oligonucleotide
tctaagtataaatctcgaactgttt

SEQ ID NO: 735015 - DNA, 25 bp, Artificial sequence
  Synthetic oligonucleotide
aaacatgtcggttaataacaatcta

SEQ ID NO: 735016 - DNA, 25 bp, Artificial sequence
  Synthetic oligonucleotide
aaacatgtcggtaaataacaatcta

SEQ ID NO: 735017 - DNA, 25 bp, Artificial sequence
  Synthetic oligonucleotide
tacttacgtttaggttatagatttg

SEQ ID NO: 735018 - DNA, 25 bp, Artificial sequence
  Synthetic oligonucleotide
gactctttaataacgatatgacata

SEQ ID NO: 735019 - DNA, 25 bp, Artificial sequence
  Synthetic oligonucleotide
aatttttatcccccgtatagatata

SEQ ID NO: 735020 - DNA, 25 bp, Artificial sequence
  Synthetic oligonucleotide
cttcaagtacgttctaaatcattaa

SEQ ID NO: 735021 - DNA, 25 bp, Artificial sequence
  Synthetic oligonucleotide
tcatatatatgactaccgttgattt

SEQ ID NO: 735022 - DNA, 25 bp, Artificial sequence
  Synthetic oligonucleotide
tcatatatatgagtaccgttgattt

SEQ ID NO: 735023 - DNA, 25 bp, Artificial sequence
  Synthetic oligonucleotide
gaataatacgtgttcgattaattgt

SEQ ID NO: 735024 - DNA, 25 bp, Artificial sequence
  Synthetic oligonucleotide
gaataatacgtgatcgattaattgt

SEQ ID NO: 735025 - DNA, 25 bp, Artificial sequence
  Synthetic oligonucleotide
ctttacaaaattcaatcgtcttaca

SEQ ID NO: 735026 - DNA, 25 bp, Artificial sequence
  Synthetic oligonucleotide
ctttacaaaattgaatcgtcttaca

SEQ ID NO: 735027 - DNA, 25 bp, Artificial sequence
  Synthetic oligonucleotide
gtactacttatttggaacgattaat

SEQ ID NO: 735028 - DNA, 25 bp, Artificial sequence
  Synthetic oligonucleotide
gtactacttattaggaacgattaat

SEQ ID NO: 735029 - DNA, 25 bp, Artificial sequence
  Synthetic oligonucleotide
gactatttttcgaattgatccaaaa

SEQ ID NO: 735030 - DNA, 25 bp, Artificial sequence
  Synthetic oligonucleotide
gactctttaatatcgatatgacata

SEQ ID NO: 735031 - DNA, 25 bp, Artificial sequence
  Synthetic oligonucleotide
ttaatttagtacctcgatacaactt

SEQ ID NO: 735032 - DNA, 25 bp, Artificial sequence
  Synthetic oligonucleotide
aatagatatcgcgatagacataaat

SEQ ID NO: 735033 - DNA, 25 bp, Artificial sequence
  Synthetic oligonucleotide
tttttcaatgttcgcgactatattt

SEQ ID NO: 735034 - DNA, 25 bp, Artificial sequence
  Synthetic oligonucleotide
tttttcaatgttggcgactatattt

SEQ ID NO: 735035 - DNA, 25 bp, Artificial sequence
  Synthetic oligonucleotide
gaactattatcgcgtagtaataatt

SEQ ID NO: 735036 - DNA, 25 bp, Artificial sequence
  Synthetic oligonucleotide
gaactattatcgggtagtaataatt

SEQ ID NO: 735037 - DNA, 25 bp, Artificial sequence
  Synthetic oligonucleotide
agtaaatcgttaacgcatatttact

SEQ ID NO: 735038 - DNA, 25 bp, Artificial sequence
  Synthetic oligonucleotide
agtaaatcgttatcgcatatttact

SEQ ID NO: 735039 - DNA, 25 bp, Artificial sequence
  Synthetic oligonucleotide
aggtaatccgatggtaataaattta

SEQ ID NO: 735040 - DNA, 25 bp, Artificial sequence
  Synthetic oligonucleotide
aggtaatccgatcgtaataaattta

SEQ ID NO: 735041 - DNA, 25 bp, Artificial sequence
  Synthetic oligonucleotide
ataacttatgtaacgacgttataag

SEQ ID NO: 735042 - DNA, 25 bp, Artificial sequence
  Synthetic oligonucleotide
taatataattacgctagcgactata

SEQ ID NO: 735043 - DNA, 25 bp, Artificial sequence
  Synthetic oligonucleotide
ttaatttagtacgtcgatacaactt

SEQ ID NO: 735044 - DNA, 25 bp, Artificial sequence
  Synthetic oligonucleotide
aaatttatctagggcgataatttgt

SEQ ID NO: 735045 - DNA, 25 bp, Artificial sequence
  Synthetic oligonucleotide
aaaatatacgcgttaacttaaactc

SEQ ID NO: 735046 - DNA, 25 bp, Artificial sequence
  Synthetic oligonucleotide
aaaatatacgcgataacttaaactc

SEQ ID NO: 735047 - DNA, 25 bp, Artificial sequence
  Synthetic oligonucleotide
aactattacatcccgtattgaattt

SEQ ID NO: 735048 - DNA, 25 bp, Artificial sequence
  Synthetic oligonucleotide
aactattacatcgcgtattgaattt

SEQ ID NO: 735049 - DNA, 25 bp, Artificial sequence
  Synthetic oligonucleotide
taacttctattatcgtacgtaaaag

SEQ ID NO: 735050 - DNA, 25 bp, Artificial sequence
  Synthetic oligonucleotide
taacttctattaacgtacgtaaaag

SEQ ID NO: 735051 - DNA, 25 bp, Artificial sequence
  Synthetic oligonucleotide
caatttattatcggcgtaaaacaat

SEQ ID NO: 735052 - DNA, 25 bp, Artificial sequence
  Synthetic oligonucleotide
caatttattatccgcgtaaaacaat

SEQ ID NO: 735053 - DNA, 25 bp, Artificial sequence
  Synthetic oligonucleotide
ataggtattagcccgatataattta

SEQ ID NO: 735054 - DNA, 25 bp, Artificial sequence
  Synthetic oligonucleotide
caacatcggtaagtttatatagaat

SEQ ID NO: 735055 - DNA, 25 bp, Artificial sequence
  Synthetic oligonucleotide
ataacttatgtatcgacgttataag

SEQ ID NO: 735056 - DNA, 25 bp, Artificial sequence
  Synthetic oligonucleotide
ttagttcgtatcctacgaatattat

SEQ ID NO: 735057 - DNA, 25 bp, Artificial sequence
  Synthetic oligonucleotide
agtatatagctatacgcgttatata

SEQ ID NO: 735058 - DNA, 25 bp, Artificial sequence
  Synthetic oligonucleotide
agtatatagctaaacgcgttatata

SEQ ID NO: 735059 - DNA, 25 bp, Artificial sequence
  Synthetic oligonucleotide
atatattagatcccgatagtttagt

SEQ ID NO: 735060 - DNA, 25 bp, Artificial sequence
  Synthetic oligonucleotide
atatattagatcgcgatagtttagt

SEQ ID NO: 735061 - DNA, 25 bp, Artificial sequence
  Synthetic oligonucleotide
aataactactcgaaacgcaattaaa

SEQ ID NO: 735062 - DNA, 25 bp, Artificial sequence
  Synthetic oligonucleotide
aataactactcgtaacgcaattaaa

SEQ ID NO: 735063 - DNA, 25 bp, Artificial sequence
  Synthetic oligonucleotide
tttgaatacgaacgcgttatatata

SEQ ID NO: 735064 - DNA, 25 bp, Artificial sequence
  Synthetic oligonucleotide
tttgaatacgaaggcgttatatata

SEQ ID NO: 735065 - DNA, 25 bp, Artificial sequence
  Synthetic oligonucleotide
attattcttatttgtcgcgtatatg

SEQ ID NO: 735066 - DNA, 25 bp, Artificial sequence
  Synthetic oligonucleotide
attattcttattagtcgcgtatatg

SEQ ID NO: 735067 - DNA, 25 bp, Artificial sequence
  Synthetic oligonucleotide
taatataattaccctagcgactata

SEQ ID NO: 735068 - DNA, 25 bp, Artificial sequence
  Synthetic oligonucleotide
taaattcgtcttatagcgtattaca

SEQ ID NO: 735069 - DNA, 25 bp, Artificial sequence
  Synthetic oligonucleotide
aatagatatcgccatagacataaat

SEQ ID NO: 735070 - DNA, 25 bp, Artificial sequence
  Synthetic oligonucleotide
ttagttcgtatcgtacgaatattat

SEQ ID NO: 735071 - DNA, 25 bp, Artificial sequence
  Synthetic oligonucleotide
tattatcgtacgaacgtaaattctt

SEQ ID NO: 735072 - DNA, 25 bp, Artificial sequence
  Synthetic oligonucleotide
tattatcgtacgtacgtaaattctt

SEQ ID NO: 735073 - DNA, 25 bp, Artificial sequence
  Synthetic oligonucleotide
aaataacggtctaacgatatactaa

SEQ ID NO: 735074 - DNA, 25 bp, Artificial sequence
  Synthetic oligonucleotide
aaataacggtcttacgatatactaa

SEQ ID NO: 735075 - DNA, 25 bp, Artificial sequence
  Synthetic oligonucleotide
taaattcgaattacgacgtttattc

SEQ ID NO: 735076 - DNA, 25 bp, Artificial sequence
  Synthetic oligonucleotide
taaattcgaatttcgacgtttattc

SEQ ID NO: 735077 - DNA, 25 bp, Artificial sequence
  Synthetic oligonucleotide
aatatacgaatatcgtacgaatatg

SEQ ID NO: 735078 - DNA, 25 bp, Artificial sequence
  Synthetic oligonucleotide
aatatacgaataacgtacgaatatg

SEQ ID NO: 735079 - DNA, 25 bp, Artificial sequence
  Synthetic oligonucleotide
aaatttatctagcgcgataatttgt

SEQ ID NO: 735080 - DNA, 25 bp, Artificial sequence
  Synthetic oligonucleotide
taaattcgtcttttagcgtattaca

SEQ ID NO: 735081 - DNA, 25 bp, Artificial sequence
  Synthetic oligonucleotide
atccgcgatattataatagatctat

SEQ ID NO: 735082 - DNA, 25 bp, Artificial sequence
  Synthetic oligonucleotide
caattaatataaaaccgaactgcat

SEQ ID NO: 735083 - DNA, 25 bp, Artificial sequence
  Synthetic oligonucleotide
cttggagtatatttcgtaaagtata

SEQ ID NO: 735084 - DNA, 25 bp, Artificial sequence
  Synthetic oligonucleotide
atacgtataatggcgtaactaatta

SEQ ID NO: 735085 - DNA, 25 bp, Artificial sequence
  Synthetic oligonucleotide
atacgtataatgccgtaactaatta

SEQ ID NO: 735086 - DNA, 25 bp, Artificial sequence
  Synthetic oligonucleotide
atttaatgcgaagtttagtacacta

SEQ ID NO: 735087 - DNA, 25 bp, Artificial sequence
  Synthetic oligonucleotide
atttaatgcgaactttagtacacta

SEQ ID NO: 735088 - DNA, 25 bp, Artificial sequence
  Synthetic oligonucleotide
atcaattcgaaagtctaacaaacat

SEQ ID NO: 735089 - DNA, 25 bp, Artificial sequence
  Synthetic oligonucleotide
atcaattcgaaactctaacaaacat

SEQ ID NO: 735090 - DNA, 25 bp, Artificial sequence
  Synthetic oligonucleotide
tcgatacgtgaatcttgtatatttt

SEQ ID NO: 735091 - DNA, 25 bp, Artificial sequence
  Synthetic oligonucleotide
tcgatacgtgaaacttgtatatttt

SEQ ID NO: 735092 - DNA, 25 bp, Artificial sequence
  Synthetic oligonucleotide
aaacggtaacgttatattgacataa

SEQ ID NO: 735093 - DNA, 25 bp, Artificial sequence
  Synthetic oligonucleotide
caatttttaacgcttaattgacaag

SEQ ID NO: 735094 - DNA, 25 bp, Artificial sequence
  Synthetic oligonucleotide
ataaagcgaattcaaatatcagtag

SEQ ID NO: 735095 - DNA, 25 bp, Artificial sequence
  Synthetic oligonucleotide
atccgcgatattttaatagatctat

SEQ ID NO: 735096 - DNA, 25 bp, Artificial sequence
  Synthetic oligonucleotide
ctctaagatataatcgataacaatg

SEQ ID NO: 735097 - DNA, 25 bp, Artificial sequence
  Synthetic oligonucleotide
ctctaagatatattcgataacaatg

SEQ ID NO: 735098 - DNA, 25 bp, Artificial sequence
  Synthetic oligonucleotide
gttttaacctattttactcgtacaa

SEQ ID NO: 735099 - DNA, 25 bp, Artificial sequence
  Synthetic oligonucleotide
gttttaacctatattactcgtacaa

SEQ ID NO: 735100 - DNA, 25 bp, Artificial sequence
  Synthetic oligonucleotide
tgatagtctaaattttgacgttctt

SEQ ID NO: 735101 - DNA, 25 bp, Artificial sequence
  Synthetic oligonucleotide
tgatagtctaaaatttgacgttctt

SEQ ID NO: 735102 - DNA, 25 bp, Artificial sequence
  Synthetic oligonucleotide
ctaaacgaatatcgtttgatttgat

SEQ ID NO: 735103 - DNA, 25 bp, Artificial sequence
  Synthetic oligonucleotide
ctaaacgaatatggtttgatttgat

SEQ ID NO: 735104 - DNA, 25 bp, Artificial sequence
  Synthetic oligonucleotide
caattaatataataccgaactgcat

SEQ ID NO: 735105 - DNA, 25 bp, Artificial sequence
  Synthetic oligonucleotide
caatttttaacggttaattgacaag

SEQ ID NO: 735106 - DNA, 25 bp, Artificial sequence
  Synthetic oligonucleotide
taattggtttacgatttgatcatct

SEQ ID NO: 735107 - DNA, 25 bp, Artificial sequence
  Synthetic oligonucleotide
atatctgttcgaaatttatggatag

SEQ ID NO: 735108 - DNA, 25 bp, Artificial sequence
  Synthetic oligonucleotide
aatttttatcccgcgtatagatata

SEQ ID NO: 735109 - DNA, 25 bp, Artificial sequence
  Synthetic oligonucleotide
tattttatcatatcgatacgcacat

SEQ ID NO: 735110 - DNA, 25 bp, Artificial sequence
  Synthetic oligonucleotide
cttggagtatatatcgtaaagtata

SEQ ID NO: 735111 - DNA, 25 bp, Artificial sequence
  Synthetic oligonucleotide
tcattctattacggttaattcactt

SEQ ID NO: 735112 - DNA, 25 bp, Artificial sequence
  Synthetic oligonucleotide
tcattctattaccgttaattcactt

SEQ ID NO: 735113 - DNA, 25 bp, Artificial sequence
  Synthetic oligonucleotide
tctagattgataaatttcgatcaga

SEQ ID NO: 735114 - DNA, 25 bp, Artificial sequence
  Synthetic oligonucleotide
tctagattgatatatttcgatcaga

SEQ ID NO: 735115 - DNA, 25 bp, Artificial sequence
  Synthetic oligonucleotide
aatacataaataagtggcgaatcaa

SEQ ID NO: 735116 - DNA, 25 bp, Artificial sequence
  Synthetic oligonucleotide
aatacataaatatgtggcgaatcaa

SEQ ID NO: 735117 - DNA, 25 bp, Artificial sequence
  Synthetic oligonucleotide
atttgcgtttaaatacgtcaaaatg

SEQ ID NO: 735118 - DNA, 25 bp, Artificial sequence
  Synthetic oligonucleotide
tgttaaaaacgtaattcgatactga

SEQ ID NO: 735119 - DNA, 25 bp, Artificial sequence
  Synthetic oligonucleotide
atttgcgtttaattacgtcaaaatg

SEQ ID NO: 735120 - DNA, 25 bp, Artificial sequence
  Synthetic oligonucleotide
taattggtttaccatttgatcatct

SEQ ID NO: 735121 - DNA, 25 bp, Artificial sequence
  Synthetic oligonucleotide
caactatatcgaattatactgagat

SEQ ID NO: 735122 - DNA, 25 bp, Artificial sequence
  Synthetic oligonucleotide
caactatatcgatttatactgagat

SEQ ID NO: 735123 - DNA, 25 bp, Artificial sequence
  Synthetic oligonucleotide
aacactaaccgatattaagtaagaa

SEQ ID NO: 735124 - DNA, 25 bp, Artificial sequence
  Synthetic oligonucleotide
aacactaaccgaaattaagtaagaa

SEQ ID NO: 735125 - DNA, 25 bp, Artificial sequence
  Synthetic oligonucleotide
tgaacattcgaatattagttcttac

SEQ ID NO: 735126 - DNA, 25 bp, Artificial sequence
  Synthetic oligonucleotide
tgaacattcgaaaattagttcttac

SEQ ID NO: 735127 - DNA, 25 bp, Artificial sequence
  Synthetic oligonucleotide
tcattgatctatatactcgaatttc

SEQ ID NO: 735128 - DNA, 25 bp, Artificial sequence
  Synthetic oligonucleotide
tcattgatctatttactcgaatttc

SEQ ID NO: 735129 - DNA, 25 bp, Artificial sequence
  Synthetic oligonucleotide
ataaagcgaattgaaatatcagtag

SEQ ID NO: 735130 - DNA, 25 bp, Artificial sequence
  Synthetic oligonucleotide
tgttaaaaacgttattcgatactga

SEQ ID NO: 735131 - DNA, 25 bp, Artificial sequence
  Synthetic oligonucleotide
ttcattagggaatatatcgtcaaat

SEQ ID NO: 735132 - DNA, 25 bp, Artificial sequence
  Synthetic oligonucleotide
tttctcaacgtatcgttaaactaaa

SEQ ID NO: 735133 - DNA, 25 bp, Artificial sequence
  Synthetic oligonucleotide
gtaaaatcgtaggtgtaaaatatgt

SEQ ID NO: 735134 - DNA, 25 bp, Artificial sequence
  Synthetic oligonucleotide
gtaaaatcgtagctgtaaaatatgt

SEQ ID NO: 735135 - DNA, 25 bp, Artificial sequence
  Synthetic oligonucleotide
actgtcttatacgatttaatcaatg

SEQ ID NO: 735136 - DNA, 25 bp, Artificial sequence
  Synthetic oligonucleotide
actgtcttataccatttaatcaatg

SEQ ID NO: 735137 - DNA, 25 bp, Artificial sequence
  Synthetic oligonucleotide
agctcttatatcctattagatatct

SEQ ID NO: 735138 - DNA, 25 bp, Artificial sequence
  Synthetic oligonucleotide
agctcttatatcgtattagatatct

SEQ ID NO: 735139 - DNA, 25 bp, Artificial sequence
  Synthetic oligonucleotide
ggatgactaatattatacgaattga

SEQ ID NO: 735140 - DNA, 25 bp, Artificial sequence
  Synthetic oligonucleotide
ggatgactaataatatacgaattga

SEQ ID NO: 735141 - DNA, 25 bp, Artificial sequence
  Synthetic oligonucleotide
tgagaaacgagatacattacaatta

SEQ ID NO: 735142 - DNA, 25 bp, Artificial sequence
  Synthetic oligonucleotide
tttctcaacgtaacgttaaactaaa

SEQ ID NO: 735143 - DNA, 25 bp, Artificial sequence
  Synthetic oligonucleotide
ttcattagggaaaatatcgtcaaat

SEQ ID NO: 735144 - DNA, 25 bp, Artificial sequence
  Synthetic oligonucleotide
gcatatgaattatacgtacgtttat

SEQ ID NO: 735145 - DNA, 25 bp, Artificial sequence
  Synthetic oligonucleotide
aatctcgtataactaagattcacat

SEQ ID NO: 735146 - DNA, 25 bp, Artificial sequence
  Synthetic oligonucleotide
aatctcgtataagtaagattcacat

SEQ ID NO: 735147 - DNA, 25 bp, Artificial sequence
  Synthetic oligonucleotide
tttaatcgaattacttaactcctga

SEQ ID NO: 735148 - DNA, 25 bp, Artificial sequence
  Synthetic oligonucleotide
tttaatcgaatttcttaactcctga

SEQ ID NO: 735149 - DNA, 25 bp, Artificial sequence
  Synthetic oligonucleotide
cagttcaataattaacgttagtaga

SEQ ID NO: 735150 - DNA, 25 bp, Artificial sequence
  Synthetic oligonucleotide
cagttcaataataaacgttagtaga

SEQ ID NO: 735151 - DNA, 25 bp, Artificial sequence
  Synthetic oligonucleotide
gcatatgaattaaacgtacgtttat

SEQ ID NO: 735152 - DNA, 25 bp, Artificial sequence
  Synthetic oligonucleotide
gtactacgttaagtataagtcttat

SEQ ID NO: 735153 - DNA, 25 bp, Artificial sequence
  Synthetic oligonucleotide
agacccgtattcttatattaaatga

SEQ ID NO: 735154 - DNA, 25 bp, Artificial sequence
  Synthetic oligonucleotide
aaacggtaacgtaatattgacataa

SEQ ID NO: 735155 - DNA, 25 bp, Artificial sequence
  Synthetic oligonucleotide
agacccgtattcatatattaaatga

SEQ ID NO: 735156 - DNA, 25 bp, Artificial sequence
  Synthetic oligonucleotide
tgagaaacgagaaacattacaatta

SEQ ID NO: 735157 - DNA, 25 bp, Artificial sequence
  Synthetic oligonucleotide
aagaatagaccgaattaataacttg

SEQ ID NO: 735158 - DNA, 25 bp, Artificial sequence
  Synthetic oligonucleotide
ggatttcgctttttaatatatgtgt

SEQ ID NO: 735159 - DNA, 25 bp, Artificial sequence
  Synthetic oligonucleotide
aagaatagaccgtattaataacttg

SEQ ID NO: 735160 - DNA, 25 bp, Artificial sequence
  Synthetic oligonucleotide
ttcatttcgttcaattaagtacgat

SEQ ID NO: 735161 - DNA, 25 bp, Artificial sequence
  Synthetic oligonucleotide
ttcatttcgttctattaagtacgat

SEQ ID NO: 735162 - DNA, 25 bp, Artificial sequence
  Synthetic oligonucleotide
cagtatatattattccgatagacta

SEQ ID NO: 735163 - DNA, 25 bp, Artificial sequence
  Synthetic oligonucleotide
cagtatatattaatccgatagacta

SEQ ID NO: 735164 - DNA, 25 bp, Artificial sequence
  Synthetic oligonucleotide
gtcaaatcggacgaattatattaaa

SEQ ID NO: 735165 - DNA, 25 bp, Artificial sequence
  Synthetic oligonucleotide
gtcaaatcggaccaattatattaaa

SEQ ID NO: 735166 - DNA, 25 bp, Artificial sequence
  Synthetic oligonucleotide
ctttatacccaattacgataatgta

SEQ ID NO: 735167 - DNA, 25 bp, Artificial sequence
  Synthetic oligonucleotide
ctttatacccaaatacgataatgta

SEQ ID NO: 735168 - DNA, 25 bp, Artificial sequence
  Synthetic oligonucleotide
acattatttaatcgaaaagtcgtac

SEQ ID NO: 735169 - DNA, 25 bp, Artificial sequence
  Synthetic oligonucleotide
acattatttaatggaaaagtcgtac

SEQ ID NO: 735170 - DNA, 25 bp, Artificial sequence
  Synthetic oligonucleotide
cgatagtacgctttaataattctat

SEQ ID NO: 735171 - DNA, 25 bp, Artificial sequence
  Synthetic oligonucleotide
gtactacgttaactataagtcttat

SEQ ID NO: 735172 - DNA, 25 bp, Artificial sequence
  Synthetic oligonucleotide
aggctaaattagggatattaaattg

SEQ ID NO: 735173 - DNA, 25 bp, Artificial sequence
  Synthetic oligonucleotide
cgtatatccgtataataagtaatac

SEQ ID NO: 735174 - DNA, 25 bp, Artificial sequence
  Synthetic oligonucleotide
ggatttcgctttataatatatgtgt

SEQ ID NO: 735175 - DNA, 25 bp, Artificial sequence
  Synthetic oligonucleotide
cgatagtacgctataataattctat

SEQ ID NO: 735176 - DNA, 25 bp, Artificial sequence
  Synthetic oligonucleotide
ataatactaaaccatcatttactcg

SEQ ID NO: 735177 - DNA, 25 bp, Artificial sequence
  Synthetic oligonucleotide
ataatactaaacgatcatttactcg

SEQ ID NO: 735178 - DNA, 25 bp, Artificial sequence
  Synthetic oligonucleotide
cgttctttaacacgatataaacatt

SEQ ID NO: 735179 - DNA, 25 bp, Artificial sequence
  Synthetic oligonucleotide
cgttctttaacaggatataaacatt

SEQ ID NO: 735180 - DNA, 25 bp, Artificial sequence
  Synthetic oligonucleotide
aggctaaattagcgatattaaattg

SEQ ID NO: 735181 - DNA, 25 bp, Artificial sequence
  Synthetic oligonucleotide
cgtatatccgtaaaataagtaatac

SEQ ID NO: 735182 - DNA, 25 bp, Artificial sequence
  Synthetic oligonucleotide
atacgaattctaattaacggtagtg

SEQ ID NO: 735183 - DNA, 25 bp, Artificial sequence
  Synthetic oligonucleotide
gaataatcttagctttatcgtcttg

SEQ ID NO: 735184 - DNA, 25 bp, Artificial sequence
  Synthetic oligonucleotide
gaataatcttaggtttatcgtcttg

SEQ ID NO: 735185 - DNA, 25 bp, Artificial sequence
  Synthetic oligonucleotide
gtttgaattcaaggctagtaagaat

SEQ ID NO: 735186 - DNA, 25 bp, Artificial sequence
  Synthetic oligonucleotide
gtttgaattcaacgctagtaagaat

SEQ ID NO: 735187 - DNA, 25 bp, Artificial sequence
  Synthetic oligonucleotide
gttaatattttcgctagtacagttg

SEQ ID NO: 735188 - DNA, 25 bp, Artificial sequence
  Synthetic oligonucleotide
gttaatattttccctagtacagttg

SEQ ID NO: 735189 - DNA, 25 bp, Artificial sequence
  Synthetic oligonucleotide
atacgaattctatttaacggtagtg

SEQ ID NO: 735190 - DNA, 25 bp, Artificial sequence
  Synthetic oligonucleotide
gttgattgcgaattatcaaggtttt

SEQ ID NO: 735191 - DNA, 25 bp, Artificial sequence
  Synthetic oligonucleotide
tatattttagtaggctccggtaaat

SEQ ID NO: 735192 - DNA, 25 bp, Artificial sequence
  Synthetic oligonucleotide
ttggcaatttaaccgatcttataag

SEQ ID NO: 735193 - DNA, 25 bp, Artificial sequence
  Synthetic oligonucleotide
gttgattgcgaaatatcaaggtttt

SEQ ID NO: 735194 - DNA, 25 bp, Artificial sequence
  Synthetic oligonucleotide
tgtacgcaaattagacgaatagtat

SEQ ID NO: 735195 - DNA, 25 bp, Artificial sequence
  Synthetic oligonucleotide
aactattacctaggttcgcaattaa

SEQ ID NO: 735196 - DNA, 25 bp, Artificial sequence
  Synthetic oligonucleotide
tgtacgcaaatttgacgaatagtat

SEQ ID NO: 735197 - DNA, 25 bp, Artificial sequence
  Synthetic oligonucleotide
atactattgagtggtaccgttataa

SEQ ID NO: 735198 - DNA, 25 bp, Artificial sequence
  Synthetic oligonucleotide
tatattttagtacgctccggtaaat

SEQ ID NO: 735199 - DNA, 25 bp, Artificial sequence
  Synthetic oligonucleotide
actttatcgcgatctaggttaaata

SEQ ID NO: 735200 - DNA, 25 bp, Artificial sequence
  Synthetic oligonucleotide
actttatcgcgaactaggttaaata

SEQ ID NO: 735201 - DNA, 25 bp, Artificial sequence
  Synthetic oligonucleotide
ttatattattcgccccgtaaatagt

SEQ ID NO: 735202 - DNA, 25 bp, Artificial sequence
  Synthetic oligonucleotide
ttatattattcggcccgtaaatagt

SEQ ID NO: 735203 - DNA, 25 bp, Artificial sequence
  Synthetic oligonucleotide
ttggcaatttaagcgatcttataag

SEQ ID NO: 735204 - DNA, 25 bp, Artificial sequence
  Synthetic oligonucleotide
tagctcgtaaacgacttatttctat

SEQ ID NO: 735205 - DNA, 25 bp, Artificial sequence
  Synthetic oligonucleotide
atactattgagtcgtaccgttataa

SEQ ID NO: 735206 - DNA, 25 bp, Artificial sequence
  Synthetic oligonucleotide
tttatatctagagtaaacgagccat

SEQ ID NO: 735207 - DNA, 25 bp, Artificial sequence
  Synthetic oligonucleotide
aactattacctacgttcgcaattaa

SEQ ID NO: 735208 - DNA, 25 bp, Artificial sequence
  Synthetic oligonucleotide
tttatatctagactaaacgagccat

SEQ ID NO: 735209 - DNA, 25 bp, Artificial sequence
  Synthetic oligonucleotide
tagattgatatcctcgaaattcatg

SEQ ID NO: 735210 - DNA, 25 bp, Artificial sequence
  Synthetic oligonucleotide
tagattgatatcgtcgaaattcatg

SEQ ID NO: 735211 - DNA, 25 bp, Artificial sequence
  Synthetic oligonucleotide
atgacaaagttcgtcactttgtaaa

SEQ ID NO: 735212 - DNA, 25 bp, Artificial sequence
  Synthetic oligonucleotide
atgacaaagttcctcactttgtaaa

SEQ ID NO: 735213 - DNA, 25 bp, Artificial sequence
  Synthetic oligonucleotide
attggtcattcgctattaatttcgt

SEQ ID NO: 735214 - DNA, 25 bp, Artificial sequence
  Synthetic oligonucleotide
attggtcattcggtattaatttcgt

SEQ ID NO: 735215 - DNA, 25 bp, Artificial sequence
  Synthetic oligonucleotide
ccttattacgctaaatacattcaga

SEQ ID NO: 735216 - DNA, 25 bp, Artificial sequence
  Synthetic oligonucleotide
gtttaatttccgatacaatagtagc

SEQ ID NO: 735217 - DNA, 25 bp, Artificial sequence
  Synthetic oligonucleotide
tagctcgtaaaccacttatttctat

SEQ ID NO: 735218 - DNA, 25 bp, Artificial sequence
  Synthetic oligonucleotide
gatcaagacatattacttcgttgaa

SEQ ID NO: 735219 - DNA, 25 bp, Artificial sequence
  Synthetic oligonucleotide
gtttaatttccgttacaatagtagc

SEQ ID NO: 735220 - DNA, 25 bp, Artificial sequence
  Synthetic oligonucleotide
atagtgttttgatctaatcgctatg

SEQ ID NO: 735221 - DNA, 25 bp, Artificial sequence
  Synthetic oligonucleotide
atagtgttttgaactaatcgctatg

SEQ ID NO: 735222 - DNA, 25 bp, Artificial sequence
  Synthetic oligonucleotide
tcatttatttcggtatcgatcagta

SEQ ID NO: 735223 - DNA, 25 bp, Artificial sequence
  Synthetic oligonucleotide
tcatttatttcgctatcgatcagta

SEQ ID NO: 735224 - DNA, 25 bp, Artificial sequence
  Synthetic oligonucleotide
agatttgatttgacaattcgctagt

SEQ ID NO: 735225 - DNA, 25 bp, Artificial sequence
  Synthetic oligonucleotide
agatttgatttgtcaattcgctagt

SEQ ID NO: 735226 - DNA, 25 bp, Artificial sequence
  Synthetic oligonucleotide
ctaagtcttacttgtacgaatatgt

SEQ ID NO: 735227 - DNA, 25 bp, Artificial sequence
  Synthetic oligonucleotide
ctaagtcttactagtacgaatatgt

SEQ ID NO: 735228 - DNA, 25 bp, Artificial sequence
  Synthetic oligonucleotide
gatcaagacataatacttcgttgaa

SEQ ID NO: 735229 - DNA, 25 bp, Artificial sequence
  Synthetic oligonucleotide
ccttattacgcttaatacattcaga

SEQ ID NO: 735230 - DNA, 25 bp, Artificial sequence
  Synthetic oligonucleotide
catttatgcgcgttaatacatatag

SEQ ID NO: 735231 - DNA, 25 bp, Artificial sequence
  Synthetic oligonucleotide
tgttaatcgcgaatagttcctaata

SEQ ID NO: 735232 - DNA, 25 bp, Artificial sequence
  Synthetic oligonucleotide
atacattttaatgcgcgaggtttat

SEQ ID NO: 735233 - DNA, 25 bp, Artificial sequence
  Synthetic oligonucleotide
taatgtttgcgtacgaactgatata

SEQ ID NO: 735234 - DNA, 25 bp, Artificial sequence
  Synthetic oligonucleotide
taatgtttgcgttcgaactgatata

SEQ ID NO: 735235 - DNA, 25 bp, Artificial sequence
  Synthetic oligonucleotide
cttactttacgtttcggacatatat

SEQ ID NO: 735236 - DNA, 25 bp, Artificial sequence
  Synthetic oligonucleotide
cttactttacgtatcggacatatat

SEQ ID NO: 735237 - DNA, 25 bp, Artificial sequence
  Synthetic oligonucleotide
tctatattacgactcgtagtgtaaa

SEQ ID NO: 735238 - DNA, 25 bp, Artificial sequence
  Synthetic oligonucleotide
tctatattacgagtcgtagtgtaaa

SEQ ID NO: 735239 - DNA, 25 bp, Artificial sequence
  Synthetic oligonucleotide
ttaacattacgatcgctacagataa

SEQ ID NO: 735240 - DNA, 25 bp, Artificial sequence
  Synthetic oligonucleotide
ttaacattacgaacgctacagataa

SEQ ID NO: 735241 - DNA, 25 bp, Artificial sequence
  Synthetic oligonucleotide
atagtacatacgtcgcgatataaaa

SEQ ID NO: 735242 - DNA, 25 bp, Artificial sequence
  Synthetic oligonucleotide
aacttattaatcggctacgctttaa

SEQ ID NO: 735243 - DNA, 25 bp, Artificial sequence
  Synthetic oligonucleotide
atagtacatacgacgcgatataaaa

SEQ ID NO: 735244 - DNA, 25 bp, Artificial sequence
  Synthetic oligonucleotide
catttatgcgcgataatacatatag

SEQ ID NO: 735245 - DNA, 25 bp, Artificial sequence
  Synthetic oligonucleotide
ttttattgcgcgtctaataggtata

SEQ ID NO: 735246 - DNA, 25 bp, Artificial sequence
  Synthetic oligonucleotide
ttttattgcgcgactaataggtata

SEQ ID NO: 735247 - DNA, 25 bp, Artificial sequence
  Synthetic oligonucleotide
atgttttctaatagcgtcgatacat

SEQ ID NO: 735248 - DNA, 25 bp, Artificial sequence
  Synthetic oligonucleotide
atgttttctaattgcgtcgatacat

SEQ ID NO: 735249 - DNA, 25 bp, Artificial sequence
  Synthetic oligonucleotide
cataaatcgtcgcatatacttgaaa

SEQ ID NO: 735250 - DNA, 25 bp, Artificial sequence
  Synthetic oligonucleotide
cataaatcgtcggatatacttgaaa

SEQ ID NO: 735251 - DNA, 25 bp, Artificial sequence
  Synthetic oligonucleotide
ctaaaatcgcgtactaagtttttga

SEQ ID NO: 735252 - DNA, 25 bp, Artificial sequence
  Synthetic oligonucleotide
ctaaaatcgcgttctaagtttttga

SEQ ID NO: 735253 - DNA, 25 bp, Artificial sequence
  Synthetic oligonucleotide
tgttaatcgcgattagttcctaata

SEQ ID NO: 735254 - DNA, 25 bp, Artificial sequence
  Synthetic oligonucleotide
aacttattaatccgctacgctttaa

SEQ ID NO: 735255 - DNA, 25 bp, Artificial sequence
  Synthetic oligonucleotide
tattttcgtcggtcgtataatagat

SEQ ID NO: 735256 - DNA, 25 bp, Artificial sequence
  Synthetic oligonucleotide
gaattttaagtccaccgctattaaa

SEQ ID NO: 735257 - DNA, 25 bp, Artificial sequence
  Synthetic oligonucleotide
ataattgtcggcgtagtatattact

SEQ ID NO: 735258 - DNA, 25 bp, Artificial sequence
  Synthetic oligonucleotide
ataattgtcggcctagtatattact

SEQ ID NO: 735259 - DNA, 25 bp, Artificial sequence
  Synthetic oligonucleotide
ttaaaaggtaccgcgaataattgta

SEQ ID NO: 735260 - DNA, 25 bp, Artificial sequence
  Synthetic oligonucleotide
ttaaaaggtaccccgaataattgta

SEQ ID NO: 735261 - DNA, 25 bp, Artificial sequence
  Synthetic oligonucleotide
aacaaaggatcgaacgctatattat

SEQ ID NO: 735262 - DNA, 25 bp, Artificial sequence
  Synthetic oligonucleotide
aacaaaggatcgtacgctatattat

SEQ ID NO: 735263 - DNA, 25 bp, Artificial sequence
  Synthetic oligonucleotide
aattaaggatataaccgcgaaacaa

SEQ ID NO: 735264 - DNA, 25 bp, Artificial sequence
  Synthetic oligonucleotide
aattaaggatattaccgcgaaacaa

SEQ ID NO: 735265 - DNA, 25 bp, Artificial sequence
  Synthetic oligonucleotide
tatgatctaaccggcgtatatatat

SEQ ID NO: 735266 - DNA, 25 bp, Artificial sequence
  Synthetic oligonucleotide
atacattttaatccgcgaggtttat

SEQ ID NO: 735267 - DNA, 25 bp, Artificial sequence
  Synthetic oligonucleotide
tattttcgtcggacgtataatagat

SEQ ID NO: 735268 - DNA, 25 bp, Artificial sequence
  Synthetic oligonucleotide
gaattttaagtcgaccgctattaaa

SEQ ID NO: 735269 - DNA, 25 bp, Artificial sequence
  Synthetic oligonucleotide
ttttaacgtatgaatcgcgtgaata

SEQ ID NO: 735270 - DNA, 25 bp, Artificial sequence
  Synthetic oligonucleotide
ttttaacgtatgtatcgcgtgaata

SEQ ID NO: 735271 - DNA, 25 bp, Artificial sequence
  Synthetic oligonucleotide
taattgcggttgggtactaaattta

SEQ ID NO: 735272 - DNA, 25 bp, Artificial sequence
  Synthetic oligonucleotide
taattgcggttgcgtactaaattta

SEQ ID NO: 735273 - DNA, 25 bp, Artificial sequence
  Synthetic oligonucleotide
tttattcgcggtttagtactgaatt

SEQ ID NO: 735274 - DNA, 25 bp, Artificial sequence
  Synthetic oligonucleotide
tttattcgcggtatagtactgaatt

SEQ ID NO: 735275 - DNA, 25 bp, Artificial sequence
  Synthetic oligonucleotide
tataatcgaatagtcgcgaaatgat

SEQ ID NO: 735276 - DNA, 25 bp, Artificial sequence
  Synthetic oligonucleotide
tataatcgaatactcgcgaaatgat

SEQ ID NO: 735277 - DNA, 25 bp, Artificial sequence
  Synthetic oligonucleotide
aaatttcctataggtcacgtaacat

SEQ ID NO: 735278 - DNA, 25 bp, Artificial sequence
  Synthetic oligonucleotide
aaatttcctatacgtcacgtaacat

SEQ ID NO: 735279 - DNA, 25 bp, Artificial sequence
  Synthetic oligonucleotide
tatgatctaacccgcgtatatatat

SEQ ID NO: 735280 - DNA, 25 bp, Artificial sequence
  Synthetic oligonucleotide
ttctctattacaatcgatcgtattc

SEQ ID NO: 735281 - DNA, 25 bp, Artificial sequence
  Synthetic oligonucleotide
gaagttcaacttattaatcgaatgc

SEQ ID NO: 735282 - DNA, 25 bp, Artificial sequence
  Synthetic oligonucleotide
ctctatattaaccgtctatagtgtt

SEQ ID NO: 735283 - DNA, 25 bp, Artificial sequence
  Synthetic oligonucleotide
ctctatattaacggtctatagtgtt

SEQ ID NO: 735284 - DNA, 25 bp, Artificial sequence
  Synthetic oligonucleotide
tcgagttaatcgtaacataggtatt

SEQ ID NO: 735285 - DNA, 25 bp, Artificial sequence
  Synthetic oligonucleotide
tcgagttaatcgaaacataggtatt

SEQ ID NO: 735286 - DNA, 25 bp, Artificial sequence
  Synthetic oligonucleotide
aagcataatcgtttactcatttgag

SEQ ID NO: 735287 - DNA, 25 bp, Artificial sequence
  Synthetic oligonucleotide
aagcataatcgtatactcatttgag

SEQ ID NO: 735288 - DNA, 25 bp, Artificial sequence
  Synthetic oligonucleotide
ttgcttacgctataaaagagaaaga

SEQ ID NO: 735289 - DNA, 25 bp, Artificial sequence
  Synthetic oligonucleotide
ttgcttacgctaaaaaagagaaaga

SEQ ID NO: 735290 - DNA, 25 bp, Artificial sequence
  Synthetic oligonucleotide
ccgatcgatattttaaactttggat

SEQ ID NO: 735291 - DNA, 25 bp, Artificial sequence
  Synthetic oligonucleotide
tcgtatcgtaataaattggagttga

SEQ ID NO: 735292 - DNA, 25 bp, Artificial sequence
  Synthetic oligonucleotide
ttctctattacattcgatcgtattc

SEQ ID NO: 735293 - DNA, 25 bp, Artificial sequence
  Synthetic oligonucleotide
ttagccgtatagtattgatattcga

SEQ ID NO: 735294 - DNA, 25 bp, Artificial sequence
  Synthetic oligonucleotide
ttcgaaaaatcgaccgaaatagatt

SEQ ID NO: 735295 - DNA, 25 bp, Artificial sequence
  Synthetic oligonucleotide
ttcgaaaaatcgtccgaaatagatt

SEQ ID NO: 735296 - DNA, 25 bp, Artificial sequence
  Synthetic oligonucleotide
tcattctaatagttcgtacatccat

SEQ ID NO: 735297 - DNA, 25 bp, Artificial sequence
  Synthetic oligonucleotide
tcattctaatagatcgtacatccat

SEQ ID NO: 735298 - DNA, 25 bp, Artificial sequence
  Synthetic oligonucleotide
ttatccgaattagtttacgatgatc

SEQ ID NO: 735299 - DNA, 25 bp, Artificial sequence
  Synthetic oligonucleotide
ttatccgaattactttacgatgatc

SEQ ID NO: 735300 - DNA, 25 bp, Artificial sequence
  Synthetic oligonucleotide
taccaaatagataaacgtactcgta

SEQ ID NO: 735301 - DNA, 25 bp, Artificial sequence
  Synthetic oligonucleotide
taccaaatagattaacgtactcgta

SEQ ID NO: 735302 - DNA, 25 bp, Artificial sequence
  Synthetic oligonucleotide
attaatccgttaaggttaaatccca

SEQ ID NO: 735303 - DNA, 25 bp, Artificial sequence
  Synthetic oligonucleotide
aaacttttatcgaattcgaaaggca

SEQ ID NO: 735304 - DNA, 25 bp, Artificial sequence
  Synthetic oligonucleotide
ccgatcgatattataaactttggat

SEQ ID NO: 735305 - DNA, 25 bp, Artificial sequence
  Synthetic oligonucleotide
aaacataagtaacaaacgtacctca

SEQ ID NO: 735306 - DNA, 25 bp, Artificial sequence
  Synthetic oligonucleotide
acttcacgcgaaaagtagataaata

SEQ ID NO: 735307 - DNA, 25 bp, Artificial sequence
  Synthetic oligonucleotide
aaacttttatcgtattcgaaaggca

SEQ ID NO: 735308 - DNA, 25 bp, Artificial sequence
  Synthetic oligonucleotide
tgaatctcgcgaaatagtctatttt

SEQ ID NO: 735309 - DNA, 25 bp, Artificial sequence
  Synthetic oligonucleotide
aacaaagatgcgagaataattatgc

SEQ ID NO: 735310 - DNA, 25 bp, Artificial sequence
  Synthetic oligonucleotide
aacaaagatgcgtgaataattatgc

SEQ ID NO: 735311 - DNA, 25 bp, Artificial sequence
  Synthetic oligonucleotide
aaagtatatatccgacttacttacc

SEQ ID NO: 735312 - DNA, 25 bp, Artificial sequence
  Synthetic oligonucleotide
aaagtatatatcggacttacttacc

SEQ ID NO: 735313 - DNA, 25 bp, Artificial sequence
  Synthetic oligonucleotide
gtaagtacaataaccgtacatactt

SEQ ID NO: 735314 - DNA, 25 bp, Artificial sequence
  Synthetic oligonucleotide
gtaagtacaatatccgtacatactt

SEQ ID NO: 735315 - DNA, 25 bp, Artificial sequence
  Synthetic oligonucleotide
agactcgtaatagtaattgaagcta

SEQ ID NO: 735316 - DNA, 25 bp, Artificial sequence
  Synthetic oligonucleotide
gaagttcaactttttaatcgaatgc

SEQ ID NO: 735317 - DNA, 25 bp, Artificial sequence
  Synthetic oligonucleotide
aaacataagtaagaaacgtacctca

SEQ ID NO: 735318 - DNA, 25 bp, Artificial sequence
  Synthetic oligonucleotide
ttagccgtatagaattgatattcga

SEQ ID NO: 735319 - DNA, 25 bp, Artificial sequence
  Synthetic oligonucleotide
atttgtatgatcccacataaaggtt

SEQ ID NO: 735320 - DNA, 25 bp, Artificial sequence
  Synthetic oligonucleotide
atttgtatgatcgcacataaaggtt

SEQ ID NO: 735321 - DNA, 25 bp, Artificial sequence
  Synthetic oligonucleotide
aatactcgctaatcctatatatctc

SEQ ID NO: 735322 - DNA, 25 bp, Artificial sequence
  Synthetic oligonucleotide
aatactcgctaaacctatatatctc

SEQ ID NO: 735323 - DNA, 25 bp, Artificial sequence
  Synthetic oligonucleotide
gattccgatcatttatgaaatccta

SEQ ID NO: 735324 - DNA, 25 bp, Artificial sequence
  Synthetic oligonucleotide
gattccgatcatatatgaaatccta

SEQ ID NO: 735325 - DNA, 25 bp, Artificial sequence
  Synthetic oligonucleotide
gtcatcttacgttaatcgtaaattg

SEQ ID NO: 735326 - DNA, 25 bp, Artificial sequence
  Synthetic oligonucleotide
gtcatcttacgtaaatcgtaaattg

SEQ ID NO: 735327 - DNA, 25 bp, Artificial sequence
  Synthetic oligonucleotide
gattaataatgaacgcactattcga

SEQ ID NO: 735328 - DNA, 25 bp, Artificial sequence
  Synthetic oligonucleotide
gattaataatgatcgcactattcga

SEQ ID NO: 735329 - DNA, 25 bp, Artificial sequence
  Synthetic oligonucleotide
tcgtatcgtaattaattggagttga

SEQ ID NO: 735330 - DNA, 25 bp, Artificial sequence
  Synthetic oligonucleotide
agactcgtaatactaattgaagcta

SEQ ID NO: 735331 - DNA, 25 bp, Artificial sequence
  Synthetic oligonucleotide
cgcacataatattacaatcgagtat

SEQ ID NO: 735332 - DNA, 25 bp, Artificial sequence
  Synthetic oligonucleotide
attcattaatcgttactagcgagtt

SEQ ID NO: 735333 - DNA, 25 bp, Artificial sequence
  Synthetic oligonucleotide
attcattaatcgatactagcgagtt

SEQ ID NO: 735334 - DNA, 25 bp, Artificial sequence
  Synthetic oligonucleotide
taatgcgataggataaactttagga

SEQ ID NO: 735335 - DNA, 25 bp, Artificial sequence
  Synthetic oligonucleotide
taatgcgataggttaaactttagga

SEQ ID NO: 735336 - DNA, 25 bp, Artificial sequence
  Synthetic oligonucleotide
agttgttgtacgaataacatatctc

SEQ ID NO: 735337 - DNA, 25 bp, Artificial sequence
  Synthetic oligonucleotide
agttgttgtacgtataacatatctc

SEQ ID NO: 735338 - DNA, 25 bp, Artificial sequence
  Synthetic oligonucleotide
acttaatgcgtcaagtattatcgta

SEQ ID NO: 735339 - DNA, 25 bp, Artificial sequence
  Synthetic oligonucleotide
acttaatgcgtctagtattatcgta

SEQ ID NO: 735340 - DNA, 25 bp, Artificial sequence
  Synthetic oligonucleotide
tcaaacgcatattagtataacgaag

SEQ ID NO: 735341 - DNA, 25 bp, Artificial sequence
  Synthetic oligonucleotide
tcaaacgcatataagtataacgaag

SEQ ID NO: 735342 - DNA, 25 bp, Artificial sequence
  Synthetic oligonucleotide
attaatccgttatggttaaatccca

SEQ ID NO: 735343 - DNA, 25 bp, Artificial sequence
  Synthetic oligonucleotide
ccaaccaatcgtattaattgatgat

SEQ ID NO: 735344 - DNA, 25 bp, Artificial sequence
  Synthetic oligonucleotide
acaatttcgacgttacatatctttg

SEQ ID NO: 735345 - DNA, 25 bp, Artificial sequence
  Synthetic oligonucleotide
cgcacataatataacaatcgagtat

SEQ ID NO: 735346 - DNA, 25 bp, Artificial sequence
  Synthetic oligonucleotide
tttagatccgagatgtttaagagtt

SEQ ID NO: 735347 - DNA, 25 bp, Artificial sequence
  Synthetic oligonucleotide
tttagatccgagttgtttaagagtt

SEQ ID NO: 735348 - DNA, 25 bp, Artificial sequence
  Synthetic oligonucleotide
ttgaagtttatttccgcaataaggt

SEQ ID NO: 735349 - DNA, 25 bp, Artificial sequence
  Synthetic oligonucleotide
ttgaagtttattaccgcaataaggt

SEQ ID NO: 735350 - DNA, 25 bp, Artificial sequence
  Synthetic oligonucleotide
ttgatcgattatttataacgccatg

SEQ ID NO: 735351 - DNA, 25 bp, Artificial sequence
  Synthetic oligonucleotide
ttgatcgattatatataacgccatg

SEQ ID NO: 735352 - DNA, 25 bp, Artificial sequence
  Synthetic oligonucleotide
ttatgataattcgctatcgataagg

SEQ ID NO: 735353 - DNA, 25 bp, Artificial sequence
  Synthetic oligonucleotide
ttatgataattccctatcgataagg

SEQ ID NO: 735354 - DNA, 25 bp, Artificial sequence
  Synthetic oligonucleotide
gtaagtaatccgtagtattaaatgc

SEQ ID NO: 735355 - DNA, 25 bp, Artificial sequence
  Synthetic oligonucleotide
ccaaccaatcgttttaattgatgat

SEQ ID NO: 735356 - DNA, 25 bp, Artificial sequence
  Synthetic oligonucleotide
atcagtcacgtataggataaatttc

SEQ ID NO: 735357 - DNA, 25 bp, Artificial sequence
  Synthetic oligonucleotide
aatgttttcgctttctaagatatcc

SEQ ID NO: 735358 - DNA, 25 bp, Artificial sequence
  Synthetic oligonucleotide
aatgttttcgctatctaagatatcc

SEQ ID NO: 735359 - DNA, 25 bp, Artificial sequence
  Synthetic oligonucleotide
ggaagataacgatttaatcctatgt

SEQ ID NO: 735360 - DNA, 25 bp, Artificial sequence
  Synthetic oligonucleotide
ggaagataacgaattaatcctatgt

SEQ ID NO: 735361 - DNA, 25 bp, Artificial sequence
  Synthetic oligonucleotide
tggtttacatcgatcattgagtaaa

SEQ ID NO: 735362 - DNA, 25 bp, Artificial sequence
  Synthetic oligonucleotide
tggtttacatcgttcattgagtaaa

SEQ ID NO: 735363 - DNA, 25 bp, Artificial sequence
  Synthetic oligonucleotide
aaaatcgaattattatttcgaccgc

SEQ ID NO: 735364 - DNA, 25 bp, Artificial sequence
  Synthetic oligonucleotide
aaaatcgaattaatatttcgaccgc

SEQ ID NO: 735365 - DNA, 25 bp, Artificial sequence
  Synthetic oligonucleotide
atatgttcttcgaagtttagcctta

SEQ ID NO: 735366 - DNA, 25 bp, Artificial sequence
  Synthetic oligonucleotide
atatgttcttcgtagtttagcctta

SEQ ID NO: 735367 - DNA, 25 bp, Artificial sequence
  Synthetic oligonucleotide
cttttatacatatgtattcgcagca

SEQ ID NO: 735368 - DNA, 25 bp, Artificial sequence
  Synthetic oligonucleotide
ttgcttacgattaattctatgtgga

SEQ ID NO: 735369 - DNA, 25 bp, Artificial sequence
  Synthetic oligonucleotide
cttttatacataagtattcgcagca

SEQ ID NO: 735370 - DNA, 25 bp, Artificial sequence
  Synthetic oligonucleotide
atcagtcacgtaaaggataaatttc

SEQ ID NO: 735371 - DNA, 25 bp, Artificial sequence
  Synthetic oligonucleotide
gtaattaaactcactatcgaacttg

SEQ ID NO: 735372 - DNA, 25 bp, Artificial sequence
  Synthetic oligonucleotide
gtaattaaactctctatcgaacttg

SEQ ID NO: 735373 - DNA, 25 bp, Artificial sequence
  Synthetic oligonucleotide
agtgttgtgcgattaattagtaagt

SEQ ID NO: 735374 - DNA, 25 bp, Artificial sequence
  Synthetic oligonucleotide
agtgttgtgcgaataattagtaagt

SEQ ID NO: 735375 - DNA, 25 bp, Artificial sequence
  Synthetic oligonucleotide
tcttccatattactccgatttgata

SEQ ID NO: 735376 - DNA, 25 bp, Artificial sequence
  Synthetic oligonucleotide
tcttccatattagtccgatttgata

SEQ ID NO: 735377 - DNA, 25 bp, Artificial sequence
  Synthetic oligonucleotide
aagaattgttattaacgtcgcactt

SEQ ID NO: 735378 - DNA, 25 bp, Artificial sequence
  Synthetic oligonucleotide
aagaattgttataaacgtcgcactt

SEQ ID NO: 735379 - DNA, 25 bp, Artificial sequence
  Synthetic oligonucleotide
acaatttcgacgatacatatctttg

SEQ ID NO: 735380 - DNA, 25 bp, Artificial sequence
  Synthetic oligonucleotide
gtaagtaatccgaagtattaaatgc

SEQ ID NO: 735381 - DNA, 25 bp, Artificial sequence
  Synthetic oligonucleotide
ttgcttacgatttattctatgtgga

SEQ ID NO: 735382 - DNA, 25 bp, Artificial sequence
  Synthetic oligonucleotide
caaaatactcgacgtattgctataa

SEQ ID NO: 735383 - DNA, 25 bp, Artificial sequence
  Synthetic oligonucleotide
cacaatacgcgctagtataatttta

SEQ ID NO: 735384 - DNA, 25 bp, Artificial sequence
  Synthetic oligonucleotide
tctaaaataattgggacgcattcat

SEQ ID NO: 735385 - DNA, 25 bp, Artificial sequence
  Synthetic oligonucleotide
tctaaaataattcggacgcattcat

SEQ ID NO: 735386 - DNA, 25 bp, Artificial sequence
  Synthetic oligonucleotide
ttacctataataggggcgtttataa

SEQ ID NO: 735387 - DNA, 25 bp, Artificial sequence
  Synthetic oligonucleotide
ttacctataatacgggcgtttataa

SEQ ID NO: 735388 - DNA, 25 bp, Artificial sequence
  Synthetic oligonucleotide
ttacacataacgacgtgacttaaat

SEQ ID NO: 735389 - DNA, 25 bp, Artificial sequence
  Synthetic oligonucleotide
ttacacataacgtcgtgacttaaat

SEQ ID NO: 735390 - DNA, 25 bp, Artificial sequence
  Synthetic oligonucleotide
ctaaatagttattcgcgactcatta

SEQ ID NO: 735391 - DNA, 25 bp, Artificial sequence
  Synthetic oligonucleotide
ctaaatagttatacgcgactcatta

SEQ ID NO: 735392 - DNA, 25 bp, Artificial sequence
  Synthetic oligonucleotide
atgtttaggttcgcgtaatattttc

SEQ ID NO: 735393 - DNA, 25 bp, Artificial sequence
  Synthetic oligonucleotide
ttttttatactatcggacgcaatac

SEQ ID NO: 735394 - DNA, 25 bp, Artificial sequence
  Synthetic oligonucleotide
caaaatactcgaggtattgctataa

SEQ ID NO: 735395 - DNA, 25 bp, Artificial sequence
  Synthetic oligonucleotide
caacatatataggacgcgaaaattt

SEQ ID NO: 735396 - DNA, 25 bp, Artificial sequence
  Synthetic oligonucleotide
tgaattacgtccgtactatcattaa

SEQ ID NO: 735397 - DNA, 25 bp, Artificial sequence
  Synthetic oligonucleotide
tgaattacgtccctactatcattaa

SEQ ID NO: 735398 - DNA, 25 bp, Artificial sequence
  Synthetic oligonucleotide
caaatgacgtatcgcgtaatattat

SEQ ID NO: 735399 - DNA, 25 bp, Artificial sequence
  Synthetic oligonucleotide
caaatgacgtatggcgtaatattat

SEQ ID NO: 735400 - DNA, 25 bp, Artificial sequence
  Synthetic oligonucleotide
taagtaacgtacccgttattagaaa

SEQ ID NO: 735401 - DNA, 25 bp, Artificial sequence
  Synthetic oligonucleotide
taagtaacgtacgcgttattagaaa

SEQ ID NO: 735402 - DNA, 25 bp, Artificial sequence
  Synthetic oligonucleotide
ctattaacgcgtcgttaatttaatc

SEQ ID NO: 735403 - DNA, 25 bp, Artificial sequence
  Synthetic oligonucleotide
ctattaacgcgtggttaatttaatc

SEQ ID NO: 735404 - DNA, 25 bp, Artificial sequence
  Synthetic oligonucleotide
tatatgacgcgttagtagtaatact

SEQ ID NO: 735405 - DNA, 25 bp, Artificial sequence
  Synthetic oligonucleotide
taacgacgcatttttccgaataaat

SEQ ID NO: 735406 - DNA, 25 bp, Artificial sequence
  Synthetic oligonucleotide
atgtttaggttcccgtaatattttc

SEQ ID NO: 735407 - DNA, 25 bp, Artificial sequence
  Synthetic oligonucleotide
gttattcgacgattatgtccaataa

SEQ ID NO: 735408 - DNA, 25 bp, Artificial sequence
  Synthetic oligonucleotide
aatgagcggtctaatcgtataatat

SEQ ID NO: 735409 - DNA, 25 bp, Artificial sequence
  Synthetic oligonucleotide
attacacgcatactatacgagtaat

SEQ ID NO: 735410 - DNA, 25 bp, Artificial sequence
  Synthetic oligonucleotide
attaaacgcaatacgtctaacatga

SEQ ID NO: 735411 - DNA, 25 bp, Artificial sequence
  Synthetic oligonucleotide
attaaacgcaattcgtctaacatga

SEQ ID NO: 735412 - DNA, 25 bp, Artificial sequence
  Synthetic oligonucleotide
acatgacgcaaaacgtactaaaaaa

SEQ ID NO: 735413 - DNA, 25 bp, Artificial sequence
  Synthetic oligonucleotide
acatgacgcaaatcgtactaaaaaa

SEQ ID NO: 735414 - DNA, 25 bp, Artificial sequence
  Synthetic oligonucleotide
atttaacgattgaacgtacaggata

SEQ ID NO: 735415 - DNA, 25 bp, Artificial sequence
  Synthetic oligonucleotide
atttaacgattgtacgtacaggata

SEQ ID NO: 735416 - DNA, 25 bp, Artificial sequence
  Synthetic oligonucleotide
ttctaacgatcaaacgtactaagaa

SEQ ID NO: 735417 - DNA, 25 bp, Artificial sequence
  Synthetic oligonucleotide
ttctaacgatcatacgtactaagaa

SEQ ID NO: 735418 - DNA, 25 bp, Artificial sequence
  Synthetic oligonucleotide
ttttttatactaacggacgcaatac

SEQ ID NO: 735419 - DNA, 25 bp, Artificial sequence
  Synthetic oligonucleotide
ctatttcgacggaatatcaatcaat

SEQ ID NO: 735420 - DNA, 25 bp, Artificial sequence
  Synthetic oligonucleotide
cacaatacgcgcaagtataatttta

SEQ ID NO: 735421 - DNA, 25 bp, Artificial sequence
  Synthetic oligonucleotide
gttattcgacgaatatgtccaataa

SEQ ID NO: 735422 - DNA, 25 bp, Artificial sequence
  Synthetic oligonucleotide
aataagcacgaccgattataacata

SEQ ID NO: 735423 - DNA, 25 bp, Artificial sequence
  Synthetic oligonucleotide
aataagcacgacggattataacata

SEQ ID NO: 735424 - DNA, 25 bp, Artificial sequence
  Synthetic oligonucleotide
gtaattattactagcgacgctttaa

SEQ ID NO: 735425 - DNA, 25 bp, Artificial sequence
  Synthetic oligonucleotide
gtaattattacttgcgacgctttaa

SEQ ID NO: 735426 - DNA, 25 bp, Artificial sequence
  Synthetic oligonucleotide
atacaaatgattcgcgctaaaacaa

SEQ ID NO: 735427 - DNA, 25 bp, Artificial sequence
  Synthetic oligonucleotide
atacaaatgattggcgctaaaacaa

SEQ ID NO: 735428 - DNA, 25 bp, Artificial sequence
  Synthetic oligonucleotide
aaaaatatatagagacgcgggaaaa

SEQ ID NO: 735429 - DNA, 25 bp, Artificial sequence
  Synthetic oligonucleotide
aaaaatatatagtgacgcgggaaaa

SEQ ID NO: 735430 - DNA, 25 bp, Artificial sequence
  Synthetic oligonucleotide
caacatatatagcacgcgaaaattt

SEQ ID NO: 735431 - DNA, 25 bp, Artificial sequence
  Synthetic oligonucleotide
ctatttcgacggtatatcaatcaat

SEQ ID NO: 735432 - DNA, 25 bp, Artificial sequence
  Synthetic oligonucleotide
cgaacacgactcgttatataatttt

SEQ ID NO: 735433 - DNA, 25 bp, Artificial sequence
  Synthetic oligonucleotide
tatatgacgcgtaagtagtaatact

SEQ ID NO: 735434 - DNA, 25 bp, Artificial sequence
  Synthetic oligonucleotide
agtatctaagttggcgatattatca

SEQ ID NO: 735435 - DNA, 25 bp, Artificial sequence
  Synthetic oligonucleotide
agtatctaagttcgcgatattatca

SEQ ID NO: 735436 - DNA, 25 bp, Artificial sequence
  Synthetic oligonucleotide
tagaatgtacgatatcgtatttcct

SEQ ID NO: 735437 - DNA, 25 bp, Artificial sequence
  Synthetic oligonucleotide
tagaatgtacgaaatcgtatttcct

SEQ ID NO: 735438 - DNA, 25 bp, Artificial sequence
  Synthetic oligonucleotide
tttttactataattcgcgatagctc

SEQ ID NO: 735439 - DNA, 25 bp, Artificial sequence
  Synthetic oligonucleotide
tttttactataaatcgcgatagctc

SEQ ID NO: 735440 - DNA, 25 bp, Artificial sequence
  Synthetic oligonucleotide
aagaatcgcgatattagtactaaac

SEQ ID NO: 735441 - DNA, 25 bp, Artificial sequence
  Synthetic oligonucleotide
aagaatcgcgattttagtactaaac

SEQ ID NO: 735442 - DNA, 25 bp, Artificial sequence
  Synthetic oligonucleotide
tcctaacgcgattactatttaatca

SEQ ID NO: 735443 - DNA, 25 bp, Artificial sequence
  Synthetic oligonucleotide
aattgatagacgtaatacgctgaaa

SEQ ID NO: 735444 - DNA, 25 bp, Artificial sequence
  Synthetic oligonucleotide
cgaacacgactccttatataatttt

SEQ ID NO: 735445 - DNA, 25 bp, Artificial sequence
  Synthetic oligonucleotide
tgactatagtacccgtaattttaca

SEQ ID NO: 735446 - DNA, 25 bp, Artificial sequence
  Synthetic oligonucleotide
acttgaccgaatcgttaattaaatg

SEQ ID NO: 735447 - DNA, 25 bp, Artificial sequence
  Synthetic oligonucleotide
acttgaccgaatggttaattaaatg

SEQ ID NO: 735448 - DNA, 25 bp, Artificial sequence
  Synthetic oligonucleotide
cattaaatgtatcgacgtaccttaa

SEQ ID NO: 735449 - DNA, 25 bp, Artificial sequence
  Synthetic oligonucleotide
cattaaatgtatggacgtaccttaa

SEQ ID NO: 735450 - DNA, 25 bp, Artificial sequence
  Synthetic oligonucleotide
ttgaatatacgagggattagtagtt

SEQ ID NO: 735451 - DNA, 25 bp, Artificial sequence
  Synthetic oligonucleotide
ttgaatatacgacggattagtagtt

SEQ ID NO: 735452 - DNA, 25 bp, Artificial sequence
  Synthetic oligonucleotide
tgttgtaagttatcgcgtatatcaa

SEQ ID NO: 735453 - DNA, 25 bp, Artificial sequence
  Synthetic oligonucleotide
tgttgtaagttaacgcgtatatcaa

SEQ ID NO: 735454 - DNA, 25 bp, Artificial sequence
  Synthetic oligonucleotide
ctttacaacgcgatatagatatctt

SEQ ID NO: 735455 - DNA, 25 bp, Artificial sequence
  Synthetic oligonucleotide
ctttacaacgcgttatagatatctt

SEQ ID NO: 735456 - DNA, 25 bp, Artificial sequence
  Synthetic oligonucleotide
tcctaacgcgataactatttaatca

SEQ ID NO: 735457 - DNA, 25 bp, Artificial sequence
  Synthetic oligonucleotide
attatattaacgcgtactaggcata

SEQ ID NO: 735458 - DNA, 25 bp, Artificial sequence
  Synthetic oligonucleotide
agtaaaacgcgactagtatcattta

SEQ ID NO: 735459 - DNA, 25 bp, Artificial sequence
  Synthetic oligonucleotide
agtaaaacgcgagtagtatcattta

SEQ ID NO: 735460 - DNA, 25 bp, Artificial sequence
  Synthetic oligonucleotide
gatatcacaacgtcgatacatttaa

SEQ ID NO: 735461 - DNA, 25 bp, Artificial sequence
  Synthetic oligonucleotide
gatatcacaacgacgatacatttaa

SEQ ID NO: 735462 - DNA, 25 bp, Artificial sequence
  Synthetic oligonucleotide
aacacaaatccgtatacgcaattat

SEQ ID NO: 735463 - DNA, 25 bp, Artificial sequence
  Synthetic oligonucleotide
aacacaaatccgaatacgcaattat

SEQ ID NO: 735464 - DNA, 25 bp, Artificial sequence
  Synthetic oligonucleotide
attacaaactccccgtataattaag

SEQ ID NO: 735465 - DNA, 25 bp, Artificial sequence
  Synthetic oligonucleotide
attacaaactccgcgtataattaag

SEQ ID NO: 735466 - DNA, 25 bp, Artificial sequence
  Synthetic oligonucleotide
ttttaaaacgtctcgatacaagagt

SEQ ID NO: 735467 - DNA, 25 bp, Artificial sequence
  Synthetic oligonucleotide
ttttaaaacgtcacgatacaagagt

SEQ ID NO: 735468 - DNA, 25 bp, Artificial sequence
  Synthetic oligonucleotide
aattgatagacgaaatacgctgaaa

SEQ ID NO: 735469 - DNA, 25 bp, Artificial sequence
  Synthetic oligonucleotide
ttaagaaacctatcgttcgataaca

SEQ ID NO: 735470 - DNA, 25 bp, Artificial sequence
  Synthetic oligonucleotide
taacgacgcattattccgaataaat

SEQ ID NO: 735471 - DNA, 25 bp, Artificial sequence
  Synthetic oligonucleotide
attatattaacgggtactaggcata

SEQ ID NO: 735472 - DNA, 25 bp, Artificial sequence
  Synthetic oligonucleotide
aattaatcgcgttaatacaccctaa

SEQ ID NO: 735473 - DNA, 25 bp, Artificial sequence
  Synthetic oligonucleotide
aattaatcgcgtaaatacaccctaa

SEQ ID NO: 735474 - DNA, 25 bp, Artificial sequence
  Synthetic oligonucleotide
aggaattcgcgtatgattattgata

SEQ ID NO: 735475 - DNA, 25 bp, Artificial sequence
  Synthetic oligonucleotide
aggaattcgcgtttgattattgata

SEQ ID NO: 735476 - DNA, 25 bp, Artificial sequence
  Synthetic oligonucleotide
attagctattacgatcggaatttca

SEQ ID NO: 735477 - DNA, 25 bp, Artificial sequence
  Synthetic oligonucleotide
attagctattaccatcggaatttca

SEQ ID NO: 735478 - DNA, 25 bp, Artificial sequence
  Synthetic oligonucleotide
atagtatatacgtttaccgtatgtc

SEQ ID NO: 735479 - DNA, 25 bp, Artificial sequence
  Synthetic oligonucleotide
atagtatatacgattaccgtatgtc

SEQ ID NO: 735480 - DNA, 25 bp, Artificial sequence
  Synthetic oligonucleotide
tgactatagtacgcgtaattttaca

SEQ ID NO: 735481 - DNA, 25 bp, Artificial sequence
  Synthetic oligonucleotide
ttaagaaacctaacgttcgataaca

SEQ ID NO: 735482 - DNA, 25 bp, Artificial sequence
  Synthetic oligonucleotide
tagagttacgagtcgactataaaaa

SEQ ID NO: 735483 - DNA, 25 bp, Artificial sequence
  Synthetic oligonucleotide
attacacgcatagtatacgagtaat

SEQ ID NO: 735484 - DNA, 25 bp, Artificial sequence
  Synthetic oligonucleotide
tgattatacgtaaagtcggtcaaat

SEQ ID NO: 735485 - DNA, 25 bp, Artificial sequence
  Synthetic oligonucleotide
tgattatacgtatagtcggtcaaat

SEQ ID NO: 735486 - DNA, 25 bp, Artificial sequence
  Synthetic oligonucleotide
tataactacgtatctccgatattca

SEQ ID NO: 735487 - DNA, 25 bp, Artificial sequence
  Synthetic oligonucleotide
tataactacgtaactccgatattca

SEQ ID NO: 735488 - DNA, 25 bp, Artificial sequence
  Synthetic oligonucleotide
tatagttacggttagtcgtaagaat

SEQ ID NO: 735489 - DNA, 25 bp, Artificial sequence
  Synthetic oligonucleotide
tatagttacggtaagtcgtaagaat

SEQ ID NO: 735490 - DNA, 25 bp, Artificial sequence
  Synthetic oligonucleotide
catacatacgcgctagtataatata

SEQ ID NO: 735491 - DNA, 25 bp, Artificial sequence
  Synthetic oligonucleotide
catacatacgcggtagtataatata

SEQ ID NO: 735492 - DNA, 25 bp, Artificial sequence
  Synthetic oligonucleotide
atatcatacgatatgacgcaagtta

SEQ ID NO: 735493 - DNA, 25 bp, Artificial sequence
  Synthetic oligonucleotide
tttcaatacgtccctagattttgat

SEQ ID NO: 735494 - DNA, 25 bp, Artificial sequence
  Synthetic oligonucleotide
tagagttacgagacgactataaaaa

SEQ ID NO: 735495 - DNA, 25 bp, Artificial sequence
  Synthetic oligonucleotide
tggttatacgttcgtcctatattat

SEQ ID NO: 735496 - DNA, 25 bp, Artificial sequence
  Synthetic oligonucleotide
ataatatacgacggtatactcttgt

SEQ ID NO: 735497 - DNA, 25 bp, Artificial sequence
  Synthetic oligonucleotide
ataatatacgaccgtatactcttgt

SEQ ID NO: 735498 - DNA, 25 bp, Artificial sequence
  Synthetic oligonucleotide
ttacgataccttttacgcgattaaa

SEQ ID NO: 735499 - DNA, 25 bp, Artificial sequence
  Synthetic oligonucleotide
ttacgataccttatacgcgattaaa

SEQ ID NO: 735500 - DNA, 25 bp, Artificial sequence
  Synthetic oligonucleotide
tattaataccggatcgtaattctgt

SEQ ID NO: 735501 - DNA, 25 bp, Artificial sequence
  Synthetic oligonucleotide
tattaataccggttcgtaattctgt

SEQ ID NO: 735502 - DNA, 25 bp, Artificial sequence
  Synthetic oligonucleotide
tattattaataccacgcgaaggttt

SEQ ID NO: 735503 - DNA, 25 bp, Artificial sequence
  Synthetic oligonucleotide
tattattaatacgacgcgaaggttt

SEQ ID NO: 735504 - DNA, 25 bp, Artificial sequence
  Synthetic oligonucleotide
cctatataagtttcgtcgcaaattt

SEQ ID NO: 735505 - DNA, 25 bp, Artificial sequence
  Synthetic oligonucleotide
cctatataagttacgtcgcaaattt

SEQ ID NO: 735506 - DNA, 25 bp, Artificial sequence
  Synthetic oligonucleotide
atatcatacgatttgacgcaagtta

SEQ ID NO: 735507 - DNA, 25 bp, Artificial sequence
  Synthetic oligonucleotide
gataagtataacgttccgctataaa

SEQ ID NO: 735508 - DNA, 25 bp, Artificial sequence
  Synthetic oligonucleotide
tttatttcgactaagttcgtcctat

SEQ ID NO: 735509 - DNA, 25 bp, Artificial sequence
  Synthetic oligonucleotide
tttatttcgacttagttcgtcctat

SEQ ID NO: 735510 - DNA, 25 bp, Artificial sequence
  Synthetic oligonucleotide
tatatgtattgcgaacgtcgaataa

SEQ ID NO: 735511 - DNA, 25 bp, Artificial sequence
  Synthetic oligonucleotide
tatatgtattgccaacgtcgaataa

SEQ ID NO: 735512 - DNA, 25 bp, Artificial sequence
  Synthetic oligonucleotide
tatgtatatgtcgcgtagaaatgta

SEQ ID NO: 735513 - DNA, 25 bp, Artificial sequence
  Synthetic oligonucleotide
tatgtatatgtcccgtagaaatgta

SEQ ID NO: 735514 - DNA, 25 bp, Artificial sequence
  Synthetic oligonucleotide
actttgtatcgcatcgtcataatta

SEQ ID NO: 735515 - DNA, 25 bp, Artificial sequence
  Synthetic oligonucleotide
actttgtatcgcttcgtcataatta

SEQ ID NO: 735516 - DNA, 25 bp, Artificial sequence
  Synthetic oligonucleotide
gatatatataccatacgcgataaag

SEQ ID NO: 735517 - DNA, 25 bp, Artificial sequence
  Synthetic oligonucleotide
gatatatataccttacgcgataaag

SEQ ID NO: 735518 - DNA, 25 bp, Artificial sequence
  Synthetic oligonucleotide
tttcaatacgtcgctagattttgat

SEQ ID NO: 735519 - DNA, 25 bp, Artificial sequence
  Synthetic oligonucleotide
attacatataatccgcgctctaaaa

SEQ ID NO: 735520 - DNA, 25 bp, Artificial sequence
  Synthetic oligonucleotide
tatgtttaacgccgtattgcaaaaa

SEQ ID NO: 735521 - DNA, 25 bp, Artificial sequence
  Synthetic oligonucleotide
gataagtataaccttccgctataaa

SEQ ID NO: 735522 - DNA, 25 bp, Artificial sequence
  Synthetic oligonucleotide
gaatagtagtcgacaatcgaaattt

SEQ ID NO: 735523 - DNA, 25 bp, Artificial sequence
  Synthetic oligonucleotide
gaatagtagtcgtcaatcgaaattt

SEQ ID NO: 735524 - DNA, 25 bp, Artificial sequence
  Synthetic oligonucleotide
gtatgttagctttacgtcgtaattt

SEQ ID NO: 735525 - DNA, 25 bp, Artificial sequence
  Synthetic oligonucleotide
gtatgttagcttaacgtcgtaattt

SEQ ID NO: 735526 - DNA, 25 bp, Artificial sequence
  Synthetic oligonucleotide
ttcatatactattcgccgaagttat

SEQ ID NO: 735527 - DNA, 25 bp, Artificial sequence
  Synthetic oligonucleotide
ttcatatactatacgccgaagttat

SEQ ID NO: 735528 - DNA, 25 bp, Artificial sequence
  Synthetic oligonucleotide
tttaaatactagtcgacgtacatac

SEQ ID NO: 735529 - DNA, 25 bp, Artificial sequence
  Synthetic oligonucleotide
tttaaatactagacgacgtacatac

SEQ ID NO: 735530 - DNA, 25 bp, Artificial sequence
  Synthetic oligonucleotide
tggttatacgttggtcctatattat

SEQ ID NO: 735531 - DNA, 25 bp, Artificial sequence
  Synthetic oligonucleotide
attacatataatgcgcgctctaaaa

SEQ ID NO: 735532 - DNA, 25 bp, Artificial sequence
  Synthetic oligonucleotide
aagatacgtaatatacgcgatgata

SEQ ID NO: 735533 - DNA, 25 bp, Artificial sequence
  Synthetic oligonucleotide
gaaaaataacgcctataggatacta

SEQ ID NO: 735534 - DNA, 25 bp, Artificial sequence
  Synthetic oligonucleotide
ttttagctaccgggatatatttttg

SEQ ID NO: 735535 - DNA, 25 bp, Artificial sequence
  Synthetic oligonucleotide
ttttagctaccgcgatatatttttg

SEQ ID NO: 735536 - DNA, 25 bp, Artificial sequence
  Synthetic oligonucleotide
aaaagactaatcctacgactatgtt

SEQ ID NO: 735537 - DNA, 25 bp, Artificial sequence
  Synthetic oligonucleotide
aaaagactaatcgtacgactatgtt

SEQ ID NO: 735538 - DNA, 25 bp, Artificial sequence
  Synthetic oligonucleotide
tgtgatctaacgcgtgataaattat

SEQ ID NO: 735539 - DNA, 25 bp, Artificial sequence
  Synthetic oligonucleotide
tgtgatctaacgggtgataaattat

SEQ ID NO: 735540 - DNA, 25 bp, Artificial sequence
  Synthetic oligonucleotide
cataaacgtctattcgtacttgttt

SEQ ID NO: 735541 - DNA, 25 bp, Artificial sequence
  Synthetic oligonucleotide
cataaacgtctaatcgtacttgttt

SEQ ID NO: 735542 - DNA, 25 bp, Artificial sequence
  Synthetic oligonucleotide
ttaaatcgtacgcgataaatattgc

SEQ ID NO: 735543 - DNA, 25 bp, Artificial sequence
  Synthetic oligonucleotide
atactactagtacgtatcggtaaaa

SEQ ID NO: 735544 - DNA, 25 bp, Artificial sequence
  Synthetic oligonucleotide
aagatacgtaatttacgcgatgata

SEQ ID NO: 735545 - DNA, 25 bp, Artificial sequence
  Synthetic oligonucleotide
tatacactatcaaatcgcggataaa

SEQ ID NO: 735546 - DNA, 25 bp, Artificial sequence
  Synthetic oligonucleotide
tttcaacgtaacccgattaaatttc

SEQ ID NO: 735547 - DNA, 25 bp, Artificial sequence
  Synthetic oligonucleotide
tttcaacgtaacgcgattaaatttc

SEQ ID NO: 735548 - DNA, 25 bp, Artificial sequence
  Synthetic oligonucleotide
tatatacggttgtaatacgtgctaa

SEQ ID NO: 735549 - DNA, 25 bp, Artificial sequence
  Synthetic oligonucleotide
tatatacggttgaaatacgtgctaa

SEQ ID NO: 735550 - DNA, 25 bp, Artificial sequence
  Synthetic oligonucleotide
tcttcacggtgaaattcgatataat

SEQ ID NO: 735551 - DNA, 25 bp, Artificial sequence
  Synthetic oligonucleotide
tcttcacggtgatattcgatataat

SEQ ID NO: 735552 - DNA, 25 bp, Artificial sequence
  Synthetic oligonucleotide
attatgcggtctttacgtaataaca

SEQ ID NO: 735553 - DNA, 25 bp, Artificial sequence
  Synthetic oligonucleotide
attatgcggtctatacgtaataaca

SEQ ID NO: 735554 - DNA, 25 bp, Artificial sequence
  Synthetic oligonucleotide
aatgagcggtcttatcgtataatat

SEQ ID NO: 735555 - DNA, 25 bp, Artificial sequence
  Synthetic oligonucleotide
acttcacgcgaatagtagataaata

SEQ ID NO: 735556 - DNA, 25 bp, Artificial sequence
  Synthetic oligonucleotide
ttaaatcgtacgggataaatattgc

SEQ ID NO: 735557 - DNA, 25 bp, Artificial sequence
  Synthetic oligonucleotide
tttccagcgcgattctatattatat

SEQ ID NO: 735558 - DNA, 25 bp, Artificial sequence
  Synthetic oligonucleotide
tgaatctcgcgatatagtctatttt

SEQ ID NO: 735559 - DNA, 25 bp, Artificial sequence
  Synthetic oligonucleotide
tatgtttaacgcggtattgcaaaaa

SEQ ID NO: 735560 - DNA, 25 bp, Artificial sequence
  Synthetic oligonucleotide
agaaatgtttaagcgtcgatttaga

SEQ ID NO: 735561 - DNA, 25 bp, Artificial sequence
  Synthetic oligonucleotide
agaaatgtttaaccgtcgatttaga

SEQ ID NO: 735562 - DNA, 25 bp, Artificial sequence
  Synthetic oligonucleotide
aagatagtacgtaatacggttcatt

SEQ ID NO: 735563 - DNA, 25 bp, Artificial sequence
  Synthetic oligonucleotide
aagatagtacgttatacggttcatt

SEQ ID NO: 735564 - DNA, 25 bp, Artificial sequence
  Synthetic oligonucleotide
tagatagtacggattacgaaaaaca

SEQ ID NO: 735565 - DNA, 25 bp, Artificial sequence
  Synthetic oligonucleotide
tagatagtacggtttacgaaaaaca

SEQ ID NO: 735566 - DNA, 25 bp, Artificial sequence
  Synthetic oligonucleotide
taaaatggtcgaggaattagtgtat

SEQ ID NO: 735567 - DNA, 25 bp, Artificial sequence
  Synthetic oligonucleotide
taaaatggtcgacgaattagtgtat

SEQ ID NO: 735568 - DNA, 25 bp, Artificial sequence
  Synthetic oligonucleotide
atactactagtaggtatcggtaaaa

SEQ ID NO: 735569 - DNA, 25 bp, Artificial sequence
  Synthetic oligonucleotide
tttccagcgcgaatctatattatat

SEQ ID NO: 735570 - DNA, 25 bp, Artificial sequence
  Synthetic oligonucleotide
gaaaaataacgcgtataggatacta

SEQ ID NO: 735571 - DNA, 25 bp, Artificial sequence
  Synthetic oligonucleotide
taaagagcgatatacgtctatatga

SEQ ID NO: 735572 - DNA, 25 bp, Artificial sequence
  Synthetic oligonucleotide
taaagagcgataaacgtctatatga

SEQ ID NO: 735573 - DNA, 25 bp, Artificial sequence
  Synthetic oligonucleotide
taaatagacgtaccgattataatgc

SEQ ID NO: 735574 - DNA, 25 bp, Artificial sequence
  Synthetic oligonucleotide
taaatagacgtagcgattataatgc

SEQ ID NO: 735575 - DNA, 25 bp, Artificial sequence
  Synthetic oligonucleotide
cataatgacgcgatctataattaac

SEQ ID NO: 735576 - DNA, 25 bp, Artificial sequence
  Synthetic oligonucleotide
cataatgacgcgttctataattaac

SEQ ID NO: 735577 - DNA, 25 bp, Artificial sequence
  Synthetic oligonucleotide
taaaaagacgattattcgctagtac

SEQ ID NO: 735578 - DNA, 25 bp, Artificial sequence
  Synthetic oligonucleotide
taaaaagacgataattcgctagtac

SEQ ID NO: 735579 - DNA, 25 bp, Artificial sequence
  Synthetic oligonucleotide
tatttagaacgagcgtataagctaa

SEQ ID NO: 735580 - DNA, 25 bp, Artificial sequence
  Synthetic oligonucleotide
tatttagaacgaccgtataagctaa

SEQ ID NO: 735581 - DNA, 25 bp, Artificial sequence
  Synthetic oligonucleotide
tatacactatcatatcgcggataaa

SEQ ID NO: 735582 - DNA, 25 bp, Artificial sequence
  Synthetic oligonucleotide
taacaatatcgacgtactagatagc

SEQ ID NO: 735583 - DNA, 25 bp, Artificial sequence
  Synthetic oligonucleotide
tactatcgcgacttattacataggt

SEQ ID NO: 735584 - DNA, 25 bp, Artificial sequence
  Synthetic oligonucleotide
ataaatcgcgcattagtattaggga

SEQ ID NO: 735585 - DNA, 25 bp, Artificial sequence
  Synthetic oligonucleotide
aagctacgcgattgatctagattat

SEQ ID NO: 735586 - DNA, 25 bp, Artificial sequence
  Synthetic oligonucleotide
aagctacgcgatagatctagattat

SEQ ID NO: 735587 - DNA, 25 bp, Artificial sequence
  Synthetic oligonucleotide
tccttacgcgattctgtatttttgt

SEQ ID NO: 735588 - DNA, 25 bp, Artificial sequence
  Synthetic oligonucleotide
tccttacgcgatactgtatttttgt

SEQ ID NO: 735589 - DNA, 25 bp, Artificial sequence
  Synthetic oligonucleotide
acttttcgcgattacctattttctg

SEQ ID NO: 735590 - DNA, 25 bp, Artificial sequence
  Synthetic oligonucleotide
acttttcgcgataacctattttctg

SEQ ID NO: 735591 - DNA, 25 bp, Artificial sequence
  Synthetic oligonucleotide
gaatatcgcgagtaactaagtacat

SEQ ID NO: 735592 - DNA, 25 bp, Artificial sequence
  Synthetic oligonucleotide
gaatatcgcgagaaactaagtacat

SEQ ID NO: 735593 - DNA, 25 bp, Artificial sequence
  Synthetic oligonucleotide
atgggatagtatttcgacgaactta

SEQ ID NO: 735594 - DNA, 25 bp, Artificial sequence
  Synthetic oligonucleotide
gtctatcgcgagatagtatgttata

SEQ ID NO: 735595 - DNA, 25 bp, Artificial sequence
  Synthetic oligonucleotide
taaggtcgcgcaatcaatatactta

SEQ ID NO: 735596 - DNA, 25 bp, Artificial sequence
  Synthetic oligonucleotide
tactatcgcgacatattacataggt

SEQ ID NO: 735597 - DNA, 25 bp, Artificial sequence
  Synthetic oligonucleotide
aaaatacgcgacaaataagataggg

SEQ ID NO: 735598 - DNA, 25 bp, Artificial sequence
  Synthetic oligonucleotide
aaaatacgcgactaataagataggg

SEQ ID NO: 735599 - DNA, 25 bp, Artificial sequence
  Synthetic oligonucleotide
aagtaacgcgaactcttatcaagaa

SEQ ID NO: 735600 - DNA, 25 bp, Artificial sequence
  Synthetic oligonucleotide
aagtaacgcgaagtcttatcaagaa

SEQ ID NO: 735601 - DNA, 25 bp, Artificial sequence
  Synthetic oligonucleotide
aacactcgccgtatagattatgttt

SEQ ID NO: 735602 - DNA, 25 bp, Artificial sequence
  Synthetic oligonucleotide
aacactcgccgtttagattatgttt

SEQ ID NO: 735603 - DNA, 25 bp, Artificial sequence
  Synthetic oligonucleotide
ttttcacgccgagaatataaatacc

SEQ ID NO: 735604 - DNA, 25 bp, Artificial sequence
  Synthetic oligonucleotide
ttttcacgccgacaatataaatacc

SEQ ID NO: 735605 - DNA, 25 bp, Artificial sequence
  Synthetic oligonucleotide
tgtattcgccgaaacattaaaccat

SEQ ID NO: 735606 - DNA, 25 bp, Artificial sequence
  Synthetic oligonucleotide
gtctatcgcgagttagtatgttata

SEQ ID NO: 735607 - DNA, 25 bp, Artificial sequence
  Synthetic oligonucleotide
agtgaacgcgttttaccatttattg

SEQ ID NO: 735608 - DNA, 25 bp, Artificial sequence
  Synthetic oligonucleotide
atatatcggtattaatccgcttgac

SEQ ID NO: 735609 - DNA, 25 bp, Artificial sequence
  Synthetic oligonucleotide
atatatcggtataaatccgcttgac

SEQ ID NO: 735610 - DNA, 25 bp, Artificial sequence
  Synthetic oligonucleotide
caaagccggtagaatacgatttatt

SEQ ID NO: 735611 - DNA, 25 bp, Artificial sequence
  Synthetic oligonucleotide
caaagccggtagtatacgatttatt

SEQ ID NO: 735612 - DNA, 25 bp, Artificial sequence
  Synthetic oligonucleotide
attatccggcgttttacatttggtt

SEQ ID NO: 735613 - DNA, 25 bp, Artificial sequence
  Synthetic oligonucleotide
attatccggcgtattacatttggtt

SEQ ID NO: 735614 - DNA, 25 bp, Artificial sequence
  Synthetic oligonucleotide
ttgaatcgcttaaacgtacgtacat

SEQ ID NO: 735615 - DNA, 25 bp, Artificial sequence
  Synthetic oligonucleotide
ttgaatcgcttatacgtacgtacat

SEQ ID NO: 735616 - DNA, 25 bp, Artificial sequence
  Synthetic oligonucleotide
taaaaacgctaccatctaatggatg

SEQ ID NO: 735617 - DNA, 25 bp, Artificial sequence
  Synthetic oligonucleotide
taaaaacgctacgatctaatggatg

SEQ ID NO: 735618 - DNA, 25 bp, Artificial sequence
  Synthetic oligonucleotide
ataaatcgcgcaatagtattaggga

SEQ ID NO: 735619 - DNA, 25 bp, Artificial sequence
  Synthetic oligonucleotide
agagatcgcgttaacgattctattt

SEQ ID NO: 735620 - DNA, 25 bp, Artificial sequence
  Synthetic oligonucleotide
taaggtcgcgcattcaatatactta

SEQ ID NO: 735621 - DNA, 25 bp, Artificial sequence
  Synthetic oligonucleotide
agtgaacgcgttataccatttattg

SEQ ID NO: 735622 - DNA, 25 bp, Artificial sequence
  Synthetic oligonucleotide
aactttcgcgtctattagtaggata

SEQ ID NO: 735623 - DNA, 25 bp, Artificial sequence
  Synthetic oligonucleotide
aactttcgcgtcaattagtaggata

SEQ ID NO: 735624 - DNA, 25 bp, Artificial sequence
  Synthetic oligonucleotide
gatatccgcgtactaagttagaata

SEQ ID NO: 735625 - DNA, 25 bp, Artificial sequence
  Synthetic oligonucleotide
gatatccgcgtagtaagttagaata

SEQ ID NO: 735626 - DNA, 25 bp, Artificial sequence
  Synthetic oligonucleotide
taattccgcgtatcatacttagtct

SEQ ID NO: 735627 - DNA, 25 bp, Artificial sequence
  Synthetic oligonucleotide
taattccgcgtaacatacttagtct

SEQ ID NO: 735628 - DNA, 25 bp, Artificial sequence
  Synthetic oligonucleotide
aaacagcgcgctagtataaaacaaa

SEQ ID NO: 735629 - DNA, 25 bp, Artificial sequence
  Synthetic oligonucleotide
aaacagcgcgcttgtataaaacaaa

SEQ ID NO: 735630 - DNA, 25 bp, Artificial sequence
  Synthetic oligonucleotide
ttaatgcgcatacgactaatctttg

SEQ ID NO: 735631 - DNA, 25 bp, Artificial sequence
  Synthetic oligonucleotide
agagatcgcgtttacgattctattt

SEQ ID NO: 735632 - DNA, 25 bp, Artificial sequence
  Synthetic oligonucleotide
agaatacagcgttatacgatctgat

SEQ ID NO: 735633 - DNA, 25 bp, Artificial sequence
  Synthetic oligonucleotide
tgtattcgccgatacattaaaccat

SEQ ID NO: 735634 - DNA, 25 bp, Artificial sequence
  Synthetic oligonucleotide
tgatttccgcgaatatctaatcaag

SEQ ID NO: 735635 - DNA, 25 bp, Artificial sequence
  Synthetic oligonucleotide
atacgaccgaaccattagtttctta

SEQ ID NO: 735636 - DNA, 25 bp, Artificial sequence
  Synthetic oligonucleotide
atacgaccgaacgattagtttctta

SEQ ID NO: 735637 - DNA, 25 bp, Artificial sequence
  Synthetic oligonucleotide
attatgcatcgtatacggtatatcc

SEQ ID NO: 735638 - DNA, 25 bp, Artificial sequence
  Synthetic oligonucleotide
attatgcatcgtttacggtatatcc

SEQ ID NO: 735639 - DNA, 25 bp, Artificial sequence
  Synthetic oligonucleotide
tcagttcatacttatcgcgatgata

SEQ ID NO: 735640 - DNA, 25 bp, Artificial sequence
  Synthetic oligonucleotide
tcagttcatactaatcgcgatgata

SEQ ID NO: 735641 - DNA, 25 bp, Artificial sequence
  Synthetic oligonucleotide
tagtaacataagcgacgatacattc

SEQ ID NO: 735642 - DNA, 25 bp, Artificial sequence
  Synthetic oligonucleotide
tagtaacataagggacgatacattc

SEQ ID NO: 735643 - DNA, 25 bp, Artificial sequence
  Synthetic oligonucleotide
aagtagccgctaaaacgataattac

SEQ ID NO: 735644 - DNA, 25 bp, Artificial sequence
  Synthetic oligonucleotide
tggaagcagtcgttatcgtatttaa

SEQ ID NO: 735645 - DNA, 25 bp, Artificial sequence
  Synthetic oligonucleotide
aagtagccgctataacgataattac

SEQ ID NO: 735646 - DNA, 25 bp, Artificial sequence
  Synthetic oligonucleotide
agaatacagcgtaatacgatctgat

SEQ ID NO: 735647 - DNA, 25 bp, Artificial sequence
  Synthetic oligonucleotide
ttttaccaattactacgcggatgaa

SEQ ID NO: 735648 - DNA, 25 bp, Artificial sequence
  Synthetic oligonucleotide
ttttaccaattagtacgcggatgaa

SEQ ID NO: 735649 - DNA, 25 bp, Artificial sequence
  Synthetic oligonucleotide
aatcttcaatgaggcgtatatgcat

SEQ ID NO: 735650 - DNA, 25 bp, Artificial sequence
  Synthetic oligonucleotide
aatcttcaatgacgcgtatatgcat

SEQ ID NO: 735651 - DNA, 25 bp, Artificial sequence
  Synthetic oligonucleotide
tagaaaattgtccgatcgttctatg

SEQ ID NO: 735652 - DNA, 25 bp, Artificial sequence
  Synthetic oligonucleotide
tagaaaattgtcggatcgttctatg

SEQ ID NO: 735653 - DNA, 25 bp, Artificial sequence
  Synthetic oligonucleotide
atatctattcgatcgcgtaatggaa

SEQ ID NO: 735654 - DNA, 25 bp, Artificial sequence
  Synthetic oligonucleotide
atatctattcgaacgcgtaatggaa

SEQ ID NO: 735655 - DNA, 25 bp, Artificial sequence
  Synthetic oligonucleotide
ttttttattaatggtcgcgaccgat

SEQ ID NO: 735656 - DNA, 25 bp, Artificial sequence
  Synthetic oligonucleotide
tggaagcagtcgatatcgtatttaa

SEQ ID NO: 735657 - DNA, 25 bp, Artificial sequence
  Synthetic oligonucleotide
atcaagcgacgcaatatcttcatta

SEQ ID NO: 735658 - DNA, 25 bp, Artificial sequence
  Synthetic oligonucleotide
aggcatcgtaatcactacgtaatta

SEQ ID NO: 735659 - DNA, 25 bp, Artificial sequence
  Synthetic oligonucleotide
acaagtcgatcggacataatgatat

SEQ ID NO: 735660 - DNA, 25 bp, Artificial sequence
  Synthetic oligonucleotide
acaagtcgatcgcacataatgatat

SEQ ID NO: 735661 - DNA, 25 bp, Artificial sequence
  Synthetic oligonucleotide
gttaaacgatatactagccctgtat

SEQ ID NO: 735662 - DNA, 25 bp, Artificial sequence
  Synthetic oligonucleotide
gttaaacgatattctagccctgtat

SEQ ID NO: 735663 - DNA, 25 bp, Artificial sequence
  Synthetic oligonucleotide
tattagcgacttttgcgtatcgtat

SEQ ID NO: 735664 - DNA, 25 bp, Artificial sequence
  Synthetic oligonucleotide
tattagcgacttatgcgtatcgtat

SEQ ID NO: 735665 - DNA, 25 bp, Artificial sequence
  Synthetic oligonucleotide
tatatgcgactatacgagatgtgaa

SEQ ID NO: 735666 - DNA, 25 bp, Artificial sequence
  Synthetic oligonucleotide
tatatgcgactaaacgagatgtgaa

SEQ ID NO: 735667 - DNA, 25 bp, Artificial sequence
  Synthetic oligonucleotide
taattacgacgctattagagtgttc

SEQ ID NO: 735668 - DNA, 25 bp, Artificial sequence
  Synthetic oligonucleotide
tgatttccgcgattatctaatcaag

SEQ ID NO: 735669 - DNA, 25 bp, Artificial sequence
  Synthetic oligonucleotide
atcaagcgacgctatatcttcatta

SEQ ID NO: 735670 - DNA, 25 bp, Artificial sequence
  Synthetic oligonucleotide
ttaatgcgcataggactaatctttg

SEQ ID NO: 735671 - DNA, 25 bp, Artificial sequence
  Synthetic oligonucleotide
atctaccgaagtatatcggtcttat

SEQ ID NO: 735672 - DNA, 25 bp, Artificial sequence
  Synthetic oligonucleotide
atctaccgaagtttatcggtcttat

SEQ ID NO: 735673 - DNA, 25 bp, Artificial sequence
  Synthetic oligonucleotide
tagagccgaaggaacgataaaattt

SEQ ID NO: 735674 - DNA, 25 bp, Artificial sequence
  Synthetic oligonucleotide
tagagccgaaggtacgataaaattt

SEQ ID NO: 735675 - DNA, 25 bp, Artificial sequence
  Synthetic oligonucleotide
ccaaaacctataatcgtcgaagtaa

SEQ ID NO: 735676 - DNA, 25 bp, Artificial sequence
  Synthetic oligonucleotide
ccaaaacctatattcgtcgaagtaa

SEQ ID NO: 735677 - DNA, 25 bp, Artificial sequence
  Synthetic oligonucleotide
tatcagcctaacgacgattatcttt

SEQ ID NO: 735678 - DNA, 25 bp, Artificial sequence
  Synthetic oligonucleotide
tatcagcctaaccacgattatcttt

SEQ ID NO: 735679 - DNA, 25 bp, Artificial sequence
  Synthetic oligonucleotide
tgaagaccgttaggtatagactaaa

SEQ ID NO: 735680 - DNA, 25 bp, Artificial sequence
  Synthetic oligonucleotide
tgaagaccgttacgtatagactaaa

SEQ ID NO: 735681 - DNA, 25 bp, Artificial sequence
  Synthetic oligonucleotide
taattacgacgcaattagagtgttc

SEQ ID NO: 735682 - DNA, 25 bp, Artificial sequence
  Synthetic oligonucleotide
gttgaactgacgttcgtataattac

SEQ ID NO: 735683 - DNA, 25 bp, Artificial sequence
  Synthetic oligonucleotide
tccattctagtaaacgtcgtagaaa

SEQ ID NO: 735684 - DNA, 25 bp, Artificial sequence
  Synthetic oligonucleotide
tagatagacgcgaatattctatctg

SEQ ID NO: 735685 - DNA, 25 bp, Artificial sequence
  Synthetic oligonucleotide
tagatagacgcgtatattctatctg

SEQ ID NO: 735686 - DNA, 25 bp, Artificial sequence
  Synthetic oligonucleotide
taagatgacgcgtactatagtttag

SEQ ID NO: 735687 - DNA, 25 bp, Artificial sequence
  Synthetic oligonucleotide
taagatgacgcgaactatagtttag

SEQ ID NO: 735688 - DNA, 25 bp, Artificial sequence
  Synthetic oligonucleotide
gcgattgacgcgtctatattattat

SEQ ID NO: 735689 - DNA, 25 bp, Artificial sequence
  Synthetic oligonucleotide
gcgattgacgcgactatattattat

SEQ ID NO: 735690 - DNA, 25 bp, Artificial sequence
  Synthetic oligonucleotide
tatttccttgacgcgatatcaacat

SEQ ID NO: 735691 - DNA, 25 bp, Artificial sequence
  Synthetic oligonucleotide
tatttccttgacccgatatcaacat

SEQ ID NO: 735692 - DNA, 25 bp, Artificial sequence
  Synthetic oligonucleotide
atataccttaaccaatcgcttgtac

SEQ ID NO: 735693 - DNA, 25 bp, Artificial sequence
  Synthetic oligonucleotide
ctttctgacgctttatacgatgatt

SEQ ID NO: 735694 - DNA, 25 bp, Artificial sequence
  Synthetic oligonucleotide
gttgaactgacgatcgtataattac

SEQ ID NO: 735695 - DNA, 25 bp, Artificial sequence
  Synthetic oligonucleotide
aggtatgacgttcgcaataaataag

SEQ ID NO: 735696 - DNA, 25 bp, Artificial sequence
  Synthetic oligonucleotide
atatcactcgcgcattaaaactttg

SEQ ID NO: 735697 - DNA, 25 bp, Artificial sequence
  Synthetic oligonucleotide
atatcactcgcggattaaaactttg

SEQ ID NO: 735698 - DNA, 25 bp, Artificial sequence
  Synthetic oligonucleotide
ggattactatatggcgtactaatga

SEQ ID NO: 735699 - DNA, 25 bp, Artificial sequence
  Synthetic oligonucleotide
ggattactatatcgcgtactaatga

SEQ ID NO: 735700 - DNA, 25 bp, Artificial sequence
  Synthetic oligonucleotide
ttttgtctatatcgcggaatgaagt

SEQ ID NO: 735701 - DNA, 25 bp, Artificial sequence
  Synthetic oligonucleotide
ttttgtctatatggcggaatgaagt

SEQ ID NO: 735702 - DNA, 25 bp, Artificial sequence
  Synthetic oligonucleotide
tttttgctataccgttcgaagtaag

SEQ ID NO: 735703 - DNA, 25 bp, Artificial sequence
  Synthetic oligonucleotide
tttttgctatacggttcgaagtaag

SEQ ID NO: 735704 - DNA, 25 bp, Artificial sequence
  Synthetic oligonucleotide
ttttaactatacccgagtaccaaca

SEQ ID NO: 735705 - DNA, 25 bp, Artificial sequence
  Synthetic oligonucleotide
ttcaaccgtaacgtcgatagttatt

SEQ ID NO: 735706 - DNA, 25 bp, Artificial sequence
  Synthetic oligonucleotide
atataccttaacgaatcgcttgtac

SEQ ID NO: 735707 - DNA, 25 bp, Artificial sequence
  Synthetic oligonucleotide
agagttgcggattatcgtttgataa

SEQ ID NO: 735708 - DNA, 25 bp, Artificial sequence
  Synthetic oligonucleotide
ggatatgcgttgtacgtataatttg

SEQ ID NO: 735709 - DNA, 25 bp, Artificial sequence
  Synthetic oligonucleotide
ggatatgcgttgaacgtataatttg

SEQ ID NO: 735710 - DNA, 25 bp, Artificial sequence
  Synthetic oligonucleotide
catagagcgttcggttatatttatg

SEQ ID NO: 735711 - DNA, 25 bp, Artificial sequence
  Synthetic oligonucleotide
catagagcgttccgttatatttatg

SEQ ID NO: 735712 - DNA, 25 bp, Artificial sequence
  Synthetic oligonucleotide
gtgttagcgttcgatactatgataa

SEQ ID NO: 735713 - DNA, 25 bp, Artificial sequence
  Synthetic oligonucleotide
gtgttagcgttccatactatgataa

SEQ ID NO: 735714 - DNA, 25 bp, Artificial sequence
  Synthetic oligonucleotide
ttgtacgcgttacttcgtataaaga

SEQ ID NO: 735715 - DNA, 25 bp, Artificial sequence
  Synthetic oligonucleotide
ttgtacgcgttagttcgtataaaga

SEQ ID NO: 735716 - DNA, 25 bp, Artificial sequence
  Synthetic oligonucleotide
atatctgcgtaaaatcgagcaatca

SEQ ID NO: 735717 - DNA, 25 bp, Artificial sequence
  Synthetic oligonucleotide
atatctgcgtaatatcgagcaatca

SEQ ID NO: 735718 - DNA, 25 bp, Artificial sequence
  Synthetic oligonucleotide
ctttctgacgctatatacgatgatt

SEQ ID NO: 735719 - DNA, 25 bp, Artificial sequence
  Synthetic oligonucleotide
acgtttgcgtaaccgtatagtataa

SEQ ID NO: 735720 - DNA, 25 bp, Artificial sequence
  Synthetic oligonucleotide
tccattctagtatacgtcgtagaaa

SEQ ID NO: 735721 - DNA, 25 bp, Artificial sequence
  Synthetic oligonucleotide
agagttgcggataatcgtttgataa

SEQ ID NO: 735722 - DNA, 25 bp, Artificial sequence
  Synthetic oligonucleotide
gttattgcgcgtaatgtaaggtaaa

SEQ ID NO: 735723 - DNA, 25 bp, Artificial sequence
  Synthetic oligonucleotide
gttattgcgcgttatgtaaggtaaa

SEQ ID NO: 735724 - DNA, 25 bp, Artificial sequence
  Synthetic oligonucleotide
aaaaatgattcgtgcgttacttcac

SEQ ID NO: 735725 - DNA, 25 bp, Artificial sequence
  Synthetic oligonucleotide
aaaaatgattcgagcgttacttcac

SEQ ID NO: 735726 - DNA, 25 bp, Artificial sequence
  Synthetic oligonucleotide
atttacgatagcctacgtttcaaag

SEQ ID NO: 735727 - DNA, 25 bp, Artificial sequence
  Synthetic oligonucleotide
atttacgatagcgtacgtttcaaag

SEQ ID NO: 735728 - DNA, 25 bp, Artificial sequence
  Synthetic oligonucleotide
agtactgataattcgtcggatctat

SEQ ID NO: 735729 - DNA, 25 bp, Artificial sequence
  Synthetic oligonucleotide
agtactgataatacgtcggatctat

SEQ ID NO: 735730 - DNA, 25 bp, Artificial sequence
  Synthetic oligonucleotide
aggtatgacgttggcaataaataag

SEQ ID NO: 735731 - DNA, 25 bp, Artificial sequence
  Synthetic oligonucleotide
acgtttgcgtaagcgtatagtataa

SEQ ID NO: 735732 - DNA, 25 bp, Artificial sequence
  Synthetic oligonucleotide
cttattcgtagaactatcgtgttag

SEQ ID NO: 735733 - DNA, 25 bp, Artificial sequence
  Synthetic oligonucleotide
ttttaactatacgcgagtaccaaca

SEQ ID NO: 735734 - DNA, 25 bp, Artificial sequence
  Synthetic oligonucleotide
ttcgaacgtccattacgatttatgt

SEQ ID NO: 735735 - DNA, 25 bp, Artificial sequence
  Synthetic oligonucleotide
ttcgaacgtccaatacgatttatgt

SEQ ID NO: 735736 - DNA, 25 bp, Artificial sequence
  Synthetic oligonucleotide
atatagcgtattgcgatactagcta

SEQ ID NO: 735737 - DNA, 25 bp, Artificial sequence
  Synthetic oligonucleotide
atatagcgtattccgatactagcta

SEQ ID NO: 735738 - DNA, 25 bp, Artificial sequence
  Synthetic oligonucleotide
aacgttcgtatcaagacgtgttaaa

SEQ ID NO: 735739 - DNA, 25 bp, Artificial sequence
  Synthetic oligonucleotide
aacgttcgtatctagacgtgttaaa

SEQ ID NO: 735740 - DNA, 25 bp, Artificial sequence
  Synthetic oligonucleotide
acttttcgtataatacgcgttgact

SEQ ID NO: 735741 - DNA, 25 bp, Artificial sequence
  Synthetic oligonucleotide
acttttcgtatattacgcgttgact

SEQ ID NO: 735742 - DNA, 25 bp, Artificial sequence
  Synthetic oligonucleotide
attctacgtataacgcgaatgaatg

SEQ ID NO: 735743 - DNA, 25 bp, Artificial sequence
  Synthetic oligonucleotide
tccatacgtcgattatacgaacatt

SEQ ID NO: 735744 - DNA, 25 bp, Artificial sequence
  Synthetic oligonucleotide
cttattcgtagatctatcgtgttag

SEQ ID NO: 735745 - DNA, 25 bp, Artificial sequence
  Synthetic oligonucleotide
atatagcgtcgaaataacgcagatt

SEQ ID NO: 735746 - DNA, 25 bp, Artificial sequence
  Synthetic oligonucleotide
acattacgtactgatacgaccattt

SEQ ID NO: 735747 - DNA, 25 bp, Artificial sequence
  Synthetic oligonucleotide
acattacgtactcatacgaccattt

SEQ ID NO: 735748 - DNA, 25 bp, Artificial sequence
  Synthetic oligonucleotide
acgaatcgtactacggatttataga

SEQ ID NO: 735749 - DNA, 25 bp, Artificial sequence
  Synthetic oligonucleotide
acgaatcgtacttcggatttataga

SEQ ID NO: 735750 - DNA, 25 bp, Artificial sequence
  Synthetic oligonucleotide
gttccacgtacgctactaaatatta

SEQ ID NO: 735751 - DNA, 25 bp, Artificial sequence
  Synthetic oligonucleotide
gttccacgtacggtactaaatatta

SEQ ID NO: 735752 - DNA, 25 bp, Artificial sequence
  Synthetic oligonucleotide
taattccgtacaataacgctccaat

SEQ ID NO: 735753 - DNA, 25 bp, Artificial sequence
  Synthetic oligonucleotide
taattccgtacattaacgctccaat

SEQ ID NO: 735754 - DNA, 25 bp, Artificial sequence
  Synthetic oligonucleotide
aggcatcgtaatgactacgtaatta

SEQ ID NO: 735755 - DNA, 25 bp, Artificial sequence
  Synthetic oligonucleotide
gtatttattaacgcgctacccataa

SEQ ID NO: 735756 - DNA, 25 bp, Artificial sequence
  Synthetic oligonucleotide
attctacgtatatcgcgaatgaatg

SEQ ID NO: 735757 - DNA, 25 bp, Artificial sequence
  Synthetic oligonucleotide
atgactcgttagaagcgtaacatat

SEQ ID NO: 735758 - DNA, 25 bp, Artificial sequence
  Synthetic oligonucleotide
tctgaactaatcggcgtatacaaat

SEQ ID NO: 735759 - DNA, 25 bp, Artificial sequence
  Synthetic oligonucleotide
tctgaactaatccgcgtatacaaat

SEQ ID NO: 735760 - DNA, 25 bp, Artificial sequence
  Synthetic oligonucleotide
acttagcgtttaggctagtaagtat

SEQ ID NO: 735761 - DNA, 25 bp, Artificial sequence
  Synthetic oligonucleotide
acttagcgtttacgctagtaagtat

SEQ ID NO: 735762 - DNA, 25 bp, Artificial sequence
  Synthetic oligonucleotide
gacaaacgtttatcgcgtatacatt

SEQ ID NO: 735763 - DNA, 25 bp, Artificial sequence
  Synthetic oligonucleotide
gacaaacgtttaacgcgtatacatt

SEQ ID NO: 735764 - DNA, 25 bp, Artificial sequence
  Synthetic oligonucleotide
gatacacgttcgtgtatagttcaaa

SEQ ID NO: 735765 - DNA, 25 bp, Artificial sequence
  Synthetic oligonucleotide
gatacacgttcgagtatagttcaaa

SEQ ID NO: 735766 - DNA, 25 bp, Artificial sequence
  Synthetic oligonucleotide
tggttacgttatagtacgctatgtt

SEQ ID NO: 735767 - DNA, 25 bp, Artificial sequence
  Synthetic oligonucleotide
tggttacgttattgtacgctatgtt

SEQ ID NO: 735768 - DNA, 25 bp, Artificial sequence
  Synthetic oligonucleotide
tccatacgtcgaatatacgaacatt

SEQ ID NO: 735769 - DNA, 25 bp, Artificial sequence
  Synthetic oligonucleotide
ttagatcgttattctcgagaggtaa

SEQ ID NO: 735770 - DNA, 25 bp, Artificial sequence
  Synthetic oligonucleotide
ttcaaccgtaacctcgatagttatt

SEQ ID NO: 735771 - DNA, 25 bp, Artificial sequence
  Synthetic oligonucleotide
atgactcgttagtagcgtaacatat

SEQ ID NO: 735772 - DNA, 25 bp, Artificial sequence
  Synthetic oligonucleotide
ctggatcgttacccgattatttaat

SEQ ID NO: 735773 - DNA, 25 bp, Artificial sequence
  Synthetic oligonucleotide
ctggatcgttacgcgattatttaat

SEQ ID NO: 735774 - DNA, 25 bp, Artificial sequence
  Synthetic oligonucleotide
gacaatcgttaagtagtcgttaatc

SEQ ID NO: 735775 - DNA, 25 bp, Artificial sequence
  Synthetic oligonucleotide
gacaatcgttaactagtcgttaatc

SEQ ID NO: 735776 - DNA, 25 bp, Artificial sequence
  Synthetic oligonucleotide
gtattacgtgtatagtcgaagatct

SEQ ID NO: 735777 - DNA, 25 bp, Artificial sequence
  Synthetic oligonucleotide
gtattacgtgtaaagtcgaagatct

SEQ ID NO: 735778 - DNA, 25 bp, Artificial sequence
  Synthetic oligonucleotide
caacaccgtcggtgtattataaaat

SEQ ID NO: 735779 - DNA, 25 bp, Artificial sequence
  Synthetic oligonucleotide
caacaccgtcggagtattataaaat

SEQ ID NO: 735780 - DNA, 25 bp, Artificial sequence
  Synthetic oligonucleotide
atatagcgtcgatataacgcagatt

SEQ ID NO: 735781 - DNA, 25 bp, Artificial sequence
  Synthetic oligonucleotide
ttagatcgttatactcgagaggtaa

SEQ ID NO: 735782 - DNA, 25 bp, Artificial sequence
  Synthetic oligonucleotide
ctgatatcgtattacgatgacactt

SEQ ID NO: 735783 - DNA, 25 bp, Artificial sequence
  Synthetic oligonucleotide
aggttatatcggtcgtaatctacaa

SEQ ID NO: 735784 - DNA, 25 bp, Artificial sequence
  Synthetic oligonucleotide
ttctgattcgcgtctatatcatagt

SEQ ID NO: 735785 - DNA, 25 bp, Artificial sequence
  Synthetic oligonucleotide
aggctattatcgatctacgaacatt

SEQ ID NO: 735786 - DNA, 25 bp, Artificial sequence
  Synthetic oligonucleotide
aggctattatcgttctacgaacatt

SEQ ID NO: 735787 - DNA, 25 bp, Artificial sequence
  Synthetic oligonucleotide
gctaacttacgcgttactaaaagat

SEQ ID NO: 735788 - DNA, 25 bp, Artificial sequence
  Synthetic oligonucleotide
gctaacttacgccttactaaaagat

SEQ ID NO: 735789 - DNA, 25 bp, Artificial sequence
  Synthetic oligonucleotide
ttgaagttacgcggataatcatatg

SEQ ID NO: 735790 - DNA, 25 bp, Artificial sequence
  Synthetic oligonucleotide
ttgaagttacgccgataatcatatg

SEQ ID NO: 735791 - DNA, 25 bp, Artificial sequence
  Synthetic oligonucleotide
atctcttgtatttacgcgatgaaga

SEQ ID NO: 735792 - DNA, 25 bp, Artificial sequence
  Synthetic oligonucleotide
atctcttgtattaacgcgatgaaga

SEQ ID NO: 735793 - DNA, 25 bp, Artificial sequence
  Synthetic oligonucleotide
ttgactttcgcgttaatacatacac

SEQ ID NO: 735794 - DNA, 25 bp, Artificial sequence
  Synthetic oligonucleotide
ttaaattcttacgcgtattgaccgt

SEQ ID NO: 735795 - DNA, 25 bp, Artificial sequence
  Synthetic oligonucleotide
ttgactttcgcgataatacatacac

SEQ ID NO: 735796 - DNA, 25 bp, Artificial sequence
  Synthetic oligonucleotide
ctgatatcgtataacgatgacactt

SEQ ID NO: 735797 - DNA, 25 bp, Artificial sequence
  Synthetic oligonucleotide
ttacagtcgatatccgttagtttct

SEQ ID NO: 735798 - DNA, 25 bp, Artificial sequence
  Synthetic oligonucleotide
ttacagtcgataaccgttagtttct

SEQ ID NO: 735799 - DNA, 25 bp, Artificial sequence
  Synthetic oligonucleotide
acagcttatgtccaacgtaacaatt

SEQ ID NO: 735800 - DNA, 25 bp, Artificial sequence
  Synthetic oligonucleotide
acagcttatgtcgaacgtaacaatt

SEQ ID NO: 735801 - DNA, 25 bp, Artificial sequence
  Synthetic oligonucleotide
tcgtaatatgcgttaacgacatact

SEQ ID NO: 735802 - DNA, 25 bp, Artificial sequence
  Synthetic oligonucleotide
tcgtaatatgcgataacgacatact

SEQ ID NO: 735803 - DNA, 25 bp, Artificial sequence
  Synthetic oligonucleotide
tgtgattatcgtcgtaagtatcaac

SEQ ID NO: 735804 - DNA, 25 bp, Artificial sequence
  Synthetic oligonucleotide
tgtgattatcgtggtaagtatcaac

SEQ ID NO: 735805 - DNA, 25 bp, Artificial sequence
  Synthetic oligonucleotide
tatttaacgatacgtcgtatcacga

SEQ ID NO: 735806 - DNA, 25 bp, Artificial sequence
  Synthetic oligonucleotide
ttaaattcttacccgtattgaccgt

SEQ ID NO: 735807 - DNA, 25 bp, Artificial sequence
  Synthetic oligonucleotide
aaagccaatcgcgttacgaatattt

SEQ ID NO: 735808 - DNA, 25 bp, Artificial sequence
  Synthetic oligonucleotide
ttttttattaatcgtcgcgaccgat

SEQ ID NO: 735809 - DNA, 25 bp, Artificial sequence
  Synthetic oligonucleotide
atttagacgagtggactatagaaca

SEQ ID NO: 735810 - DNA, 25 bp, Artificial sequence
  Synthetic oligonucleotide
atttagacgagtcgactatagaaca

SEQ ID NO: 735811 - DNA, 25 bp, Artificial sequence
  Synthetic oligonucleotide
aatgtaacgaggcgtaataaatcag

SEQ ID NO: 735812 - DNA, 25 bp, Artificial sequence
  Synthetic oligonucleotide
aatgtaacgaggggtaataaatcag

SEQ ID NO: 735813 - DNA, 25 bp, Artificial sequence
  Synthetic oligonucleotide
cttactacgaacgtcgttaattcat

SEQ ID NO: 735814 - DNA, 25 bp, Artificial sequence
  Synthetic oligonucleotide
cttactacgaacctcgttaattcat

SEQ ID NO: 735815 - DNA, 25 bp, Artificial sequence
  Synthetic oligonucleotide
caaagtacctcgacgtatttaaaca

SEQ ID NO: 735816 - DNA, 25 bp, Artificial sequence
  Synthetic oligonucleotide
caaagtacctcgtcgtatttaaaca

SEQ ID NO: 735817 - DNA, 25 bp, Artificial sequence
  Synthetic oligonucleotide
atttttaatcgccgagtatgctatc

SEQ ID NO: 735818 - DNA, 25 bp, Artificial sequence
  Synthetic oligonucleotide
ttctgattcgcgactatatcatagt

SEQ ID NO: 735819 - DNA, 25 bp, Artificial sequence
  Synthetic oligonucleotide
aaagccaatcgccttacgaatattt

SEQ ID NO: 735820 - DNA, 25 bp, Artificial sequence
  Synthetic oligonucleotide
aaccagtatcggatcgttaatgtta

SEQ ID NO: 735821 - DNA, 25 bp, Artificial sequence
  Synthetic oligonucleotide
acgtataatatccttcgcgttttgt

SEQ ID NO: 735822 - DNA, 25 bp, Artificial sequence
  Synthetic oligonucleotide
acgtataatatcgttcgcgttttgt

SEQ ID NO: 735823 - DNA, 25 bp, Artificial sequence
  Synthetic oligonucleotide
aaagataagcgtttatcggcgaatt

SEQ ID NO: 735824 - DNA, 25 bp, Artificial sequence
  Synthetic oligonucleotide
aaagataagcgtatatcggcgaatt

SEQ ID NO: 735825 - DNA, 25 bp, Artificial sequence
  Synthetic oligonucleotide
cttatgaacttagtcgcgagtaaat

SEQ ID NO: 735826 - DNA, 25 bp, Artificial sequence
  Synthetic oligonucleotide
cttatgaacttactcgcgagtaaat

SEQ ID NO: 735827 - DNA, 25 bp, Artificial sequence
  Synthetic oligonucleotide
tactaaaacgttggaacgatcgata

SEQ ID NO: 735828 - DNA, 25 bp, Artificial sequence
  Synthetic oligonucleotide
tactaaaacgttcgaacgatcgata

SEQ ID NO: 735829 - DNA, 25 bp, Artificial sequence
  Synthetic oligonucleotide
gttttaaacgattcgacctcattag

SEQ ID NO: 735830 - DNA, 25 bp, Artificial sequence
  Synthetic oligonucleotide
gttttaaacgatacgacctcattag

SEQ ID NO: 735831 - DNA, 25 bp, Artificial sequence
  Synthetic oligonucleotide
atttttaatcgcggagtatgctatc

SEQ ID NO: 735832 - DNA, 25 bp, Artificial sequence
  Synthetic oligonucleotide
aacaatcgaattagtcgtaggttca

SEQ ID NO: 735833 - DNA, 25 bp, Artificial sequence
  Synthetic oligonucleotide
aggttatatcggacgtaatctacaa

SEQ ID NO: 735834 - DNA, 25 bp, Artificial sequence
  Synthetic oligonucleotide
gaaggactattcgtaacgtcatatt

SEQ ID NO: 735835 - DNA, 25 bp, Artificial sequence
  Synthetic oligonucleotide
agcgatcgtccgatataatcattta

SEQ ID NO: 735836 - DNA, 25 bp, Artificial sequence
  Synthetic oligonucleotide
agcgatcgtccgttataatcattta

SEQ ID NO: 735837 - DNA, 25 bp, Artificial sequence
  Synthetic oligonucleotide
gtacaccggtaaacgtataagtata

SEQ ID NO: 735838 - DNA, 25 bp, Artificial sequence
  Synthetic oligonucleotide
gtacaccggtaatcgtataagtata

SEQ ID NO: 735839 - DNA, 25 bp, Artificial sequence
  Synthetic oligonucleotide
aagtgacgcgtaatacttatcttct

SEQ ID NO: 735840 - DNA, 25 bp, Artificial sequence
  Synthetic oligonucleotide
aagtgacgcgtattacttatcttct

SEQ ID NO: 735841 - DNA, 25 bp, Artificial sequence
  Synthetic oligonucleotide
attatacgcgtattaagtacgcgtt

SEQ ID NO: 735842 - DNA, 25 bp, Artificial sequence
  Synthetic oligonucleotide
attatacgcgtaataagtacgcgtt

SEQ ID NO: 735843 - DNA, 25 bp, Artificial sequence
  Synthetic oligonucleotide
atagatgtcgaatcgtatacgttct

SEQ ID NO: 735844 - DNA, 25 bp, Artificial sequence
  Synthetic oligonucleotide
cagtttcgcgaagtataatgcataa

SEQ ID NO: 735845 - DNA, 25 bp, Artificial sequence
  Synthetic oligonucleotide
atagatgtcgaaacgtatacgttct

SEQ ID NO: 735846 - DNA, 25 bp, Artificial sequence
  Synthetic oligonucleotide
aacaatcgaatttgtcgtaggttca

SEQ ID NO: 735847 - DNA, 25 bp, Artificial sequence
  Synthetic oligonucleotide
tgatggcgaatatcggttaaagaaa

SEQ ID NO: 735848 - DNA, 25 bp, Artificial sequence
  Synthetic oligonucleotide
tgatggcgaataacggttaaagaaa

SEQ ID NO: 735849 - DNA, 25 bp, Artificial sequence
  Synthetic oligonucleotide
ttacaaattacgcgtactagaaagg

SEQ ID NO: 735850 - DNA, 25 bp, Artificial sequence
  Synthetic oligonucleotide
ttacaaattacgggtactagaaagg

SEQ ID NO: 735851 - DNA, 25 bp, Artificial sequence
  Synthetic oligonucleotide
tagagtattacgaccgataagctta

SEQ ID NO: 735852 - DNA, 25 bp, Artificial sequence
  Synthetic oligonucleotide
tagagtattacgtccgataagctta

SEQ ID NO: 735853 - DNA, 25 bp, Artificial sequence
  Synthetic oligonucleotide
aatcgtatacgcgactaaaagtgtt

SEQ ID NO: 735854 - DNA, 25 bp, Artificial sequence
  Synthetic oligonucleotide
aatcgtatacgccactaaaagtgtt

SEQ ID NO: 735855 - DNA, 25 bp, Artificial sequence
  Synthetic oligonucleotide
tgagtgaatacgggatgtaagttat

SEQ ID NO: 735856 - DNA, 25 bp, Artificial sequence
  Synthetic oligonucleotide
cagtttcgcgaactataatgcataa

SEQ ID NO: 735857 - DNA, 25 bp, Artificial sequence
  Synthetic oligonucleotide
gtgtcttacgcgaattaagttctat

SEQ ID NO: 735858 - DNA, 25 bp, Artificial sequence
  Synthetic oligonucleotide
aaccagtatcggttcgttaatgtta

SEQ ID NO: 735859 - DNA, 25 bp, Artificial sequence
  Synthetic oligonucleotide
taacaatatcgaggtactagatagc

SEQ ID NO: 735860 - DNA, 25 bp, Artificial sequence
  Synthetic oligonucleotide
atgggatagtatatcgacgaactta

SEQ ID NO: 735861 - DNA, 25 bp, Artificial sequence
  Synthetic oligonucleotide
attagctagtacgcgttaagctatt

SEQ ID NO: 735862 - DNA, 25 bp, Artificial sequence
  Synthetic oligonucleotide
attagctagtacccgttaagctatt

SEQ ID NO: 735863 - DNA, 25 bp, Artificial sequence
  Synthetic oligonucleotide
tatgtctagtaattcgacgtcctta

SEQ ID NO: 735864 - DNA, 25 bp, Artificial sequence
  Synthetic oligonucleotide
tatgtctagtaaatcgacgtcctta

SEQ ID NO: 735865 - DNA, 25 bp, Artificial sequence
  Synthetic oligonucleotide
ggatcctacttaatacgcgataata

SEQ ID NO: 735866 - DNA, 25 bp, Artificial sequence
  Synthetic oligonucleotide
ggatcctacttattacgcgataata

SEQ ID NO: 735867 - DNA, 25 bp, Artificial sequence
  Synthetic oligonucleotide
ttagaatacgtcgatacatcgtaac

SEQ ID NO: 735868 - DNA, 25 bp, Artificial sequence
  Synthetic oligonucleotide
gaaggactattcctaacgtcatatt

SEQ ID NO: 735869 - DNA, 25 bp, Artificial sequence
  Synthetic oligonucleotide
gtgtcttacgcgtattaagttctat

SEQ ID NO: 735870 - DNA, 25 bp, Artificial sequence
  Synthetic oligonucleotide
aacagaacgcgataacgttatagta

SEQ ID NO: 735871 - DNA, 25 bp, Artificial sequence
  Synthetic oligonucleotide
agaaaatacgatatcgtaccgtgaa

SEQ ID NO: 735872 - DNA, 25 bp, Artificial sequence
  Synthetic oligonucleotide
agaaaatacgatttcgtaccgtgaa

SEQ ID NO: 735873 - DNA, 25 bp, Artificial sequence
  Synthetic oligonucleotide
gtacactaccgaacgtataattaac

SEQ ID NO: 735874 - DNA, 25 bp, Artificial sequence
  Synthetic oligonucleotide
gtacactaccgatcgtataattaac

SEQ ID NO: 735875 - DNA, 25 bp, Artificial sequence
  Synthetic oligonucleotide
ttaacttaattagtcgcgagcaaac

SEQ ID NO: 735876 - DNA, 25 bp, Artificial sequence
  Synthetic oligonucleotide
ttaacttaattactcgcgagcaaac

SEQ ID NO: 735877 - DNA, 25 bp, Artificial sequence
  Synthetic oligonucleotide
tgaaaataatccctcgtataccgtt

SEQ ID NO: 735878 - DNA, 25 bp, Artificial sequence
  Synthetic oligonucleotide
tgaaaataatccgtcgtataccgtt

SEQ ID NO: 735879 - DNA, 25 bp, Artificial sequence
  Synthetic oligonucleotide
ttcaaggtcgacgtaattaccatta

SEQ ID NO: 735880 - DNA, 25 bp, Artificial sequence
  Synthetic oligonucleotide
ttcaaggtcgacctaattaccatta

SEQ ID NO: 735881 - DNA, 25 bp, Artificial sequence
  Synthetic oligonucleotide
ttagaatacgtccatacatcgtaac

SEQ ID NO: 735882 - DNA, 25 bp, Artificial sequence
  Synthetic oligonucleotide
aatttgataccgatcgtacctttga

SEQ ID NO: 735883 - DNA, 25 bp, Artificial sequence
  Synthetic oligonucleotide
agtataataatcggtcgtgttatgg

SEQ ID NO: 735884 - DNA, 25 bp, Artificial sequence
  Synthetic oligonucleotide
aattatatactaggcgttggccaat

SEQ ID NO: 735885 - DNA, 25 bp, Artificial sequence
  Synthetic oligonucleotide
ataagaatacgtctcggatcgttta

SEQ ID NO: 735886 - DNA, 25 bp, Artificial sequence
  Synthetic oligonucleotide
ataagaatacgtgtcggatcgttta

SEQ ID NO: 735887 - DNA, 25 bp, Artificial sequence
  Synthetic oligonucleotide
aggaatatacgtggaggtacattta

SEQ ID NO: 735888 - DNA, 25 bp, Artificial sequence
  Synthetic oligonucleotide
aggaatatacgtcgaggtacattta

SEQ ID NO: 735889 - DNA, 25 bp, Artificial sequence
  Synthetic oligonucleotide
aaaaatatacgtttgaccgacccta

SEQ ID NO: 735890 - DNA, 25 bp, Artificial sequence
  Synthetic oligonucleotide
aaaaatatacgtatgaccgacccta

SEQ ID NO: 735891 - DNA, 25 bp, Artificial sequence
  Synthetic oligonucleotide
tgtataatacgcctcgtaaacagat

SEQ ID NO: 735892 - DNA, 25 bp, Artificial sequence
  Synthetic oligonucleotide
tgtataatacgcgtcgtaaacagat

SEQ ID NO: 735893 - DNA, 25 bp, Artificial sequence
  Synthetic oligonucleotide
aatacaataggttacgcgttgttac

SEQ ID NO: 735894 - DNA, 25 bp, Artificial sequence
  Synthetic oligonucleotide
aatacaatacgcctcattggcaaaa

SEQ ID NO: 735895 - DNA, 25 bp, Artificial sequence
  Synthetic oligonucleotide
aatacaataggtaacgcgttgttac

SEQ ID NO: 735896 - DNA, 25 bp, Artificial sequence
  Synthetic oligonucleotide
aatttgataccgttcgtacctttga

SEQ ID NO: 735897 - DNA, 25 bp, Artificial sequence
  Synthetic oligonucleotide
agatctatacccgatcgttttcata

SEQ ID NO: 735898 - DNA, 25 bp, Artificial sequence
  Synthetic oligonucleotide
agatctataccccatcgttttcata

SEQ ID NO: 735899 - DNA, 25 bp, Artificial sequence
  Synthetic oligonucleotide
accataatacagggcgataaataag

SEQ ID NO: 735900 - DNA, 25 bp, Artificial sequence
  Synthetic oligonucleotide
accataatacagcgcgataaataag

SEQ ID NO: 735901 - DNA, 25 bp, Artificial sequence
  Synthetic oligonucleotide
tttcacataatgcgcgctataaaca

SEQ ID NO: 735902 - DNA, 25 bp, Artificial sequence
  Synthetic oligonucleotide
tttcacataatgggcgctataaaca

SEQ ID NO: 735903 - DNA, 25 bp, Artificial sequence
  Synthetic oligonucleotide
gcaattataatcgtacgcgaataga

SEQ ID NO: 735904 - DNA, 25 bp, Artificial sequence
  Synthetic oligonucleotide
gcaattataatcctacgcgaataga

SEQ ID NO: 735905 - DNA, 25 bp, Artificial sequence
  Synthetic oligonucleotide
tatttaacgataggtcgtatcacga

SEQ ID NO: 735906 - DNA, 25 bp, Artificial sequence
  Synthetic oligonucleotide
aatacaatacgcgtcattggcaaaa

SEQ ID NO: 735907 - DNA, 25 bp, Artificial sequence
  Synthetic oligonucleotide
cttaatatcgcgtaaacgtaatacg

SEQ ID NO: 735908 - DNA, 25 bp, Artificial sequence
  Synthetic oligonucleotide
tgagtgaatacgcgatgtaagttat

SEQ ID NO: 735909 - DNA, 25 bp, Artificial sequence
  Synthetic oligonucleotide
tggtttatcgttcgcgatatttttc

SEQ ID NO: 735910 - DNA, 25 bp, Artificial sequence
  Synthetic oligonucleotide
tggtttatcgttggcgatatttttc

SEQ ID NO: 735911 - DNA, 25 bp, Artificial sequence
  Synthetic oligonucleotide
ctaattatcgtaaagtccggtttga

SEQ ID NO: 735912 - DNA, 25 bp, Artificial sequence
  Synthetic oligonucleotide
ctaattatcgtatagtccggtttga

SEQ ID NO: 735913 - DNA, 25 bp, Artificial sequence
  Synthetic oligonucleotide
atctacatcgtacgtcgttagttat

SEQ ID NO: 735914 - DNA, 25 bp, Artificial sequence
  Synthetic oligonucleotide
atctacatcgtaggtcgttagttat

SEQ ID NO: 735915 - DNA, 25 bp, Artificial sequence
  Synthetic oligonucleotide
tcctatatcgtaccgtagaagaatt

SEQ ID NO: 735916 - DNA, 25 bp, Artificial sequence
  Synthetic oligonucleotide
tcctatatcgtagcgtagaagaatt

SEQ ID NO: 735917 - DNA, 25 bp, Artificial sequence
  Synthetic oligonucleotide
gatctaatcgtaattcgggtatgta

SEQ ID NO: 735918 - DNA, 25 bp, Artificial sequence
  Synthetic oligonucleotide
aattatatactacgcgttggccaat

SEQ ID NO: 735919 - DNA, 25 bp, Artificial sequence
  Synthetic oligonucleotide
cttaatatcgcgaaaacgtaatacg

SEQ ID NO: 735920 - DNA, 25 bp, Artificial sequence
  Synthetic oligonucleotide
aaaaacataatacgcgtcgcaatag

SEQ ID NO: 735921 - DNA, 25 bp, Artificial sequence
  Synthetic oligonucleotide
tactttatattgggacgtctgattc

SEQ ID NO: 735922 - DNA, 25 bp, Artificial sequence
  Synthetic oligonucleotide
tactttatattgcgacgtctgattc

SEQ ID NO: 735923 - DNA, 25 bp, Artificial sequence
  Synthetic oligonucleotide
atatacatatgttcgagcgagaaag

SEQ ID NO: 735924 - DNA, 25 bp, Artificial sequence
  Synthetic oligonucleotide
atatacatatgtacgagcgagaaag

SEQ ID NO: 735925 - DNA, 25 bp, Artificial sequence
  Synthetic oligonucleotide
atagatatataccgctacgctgaat

SEQ ID NO: 735926 - DNA, 25 bp, Artificial sequence
  Synthetic oligonucleotide
atagatatatacggctacgctgaat

SEQ ID NO: 735927 - DNA, 25 bp, Artificial sequence
  Synthetic oligonucleotide
ataaggatagtaaacgcgcaaatag

SEQ ID NO: 735928 - DNA, 25 bp, Artificial sequence
  Synthetic oligonucleotide
ataaggatagtatacgcgcaaatag

SEQ ID NO: 735929 - DNA, 25 bp, Artificial sequence
  Synthetic oligonucleotide
cgatatatagtataccgcgttatgt

SEQ ID NO: 735930 - DNA, 25 bp, Artificial sequence
  Synthetic oligonucleotide
cgatatatagtaaaccgcgttatgt

SEQ ID NO: 735931 - DNA, 25 bp, Artificial sequence
  Synthetic oligonucleotide
gatctaatcgtatttcgggtatgta

SEQ ID NO: 735932 - DNA, 25 bp, Artificial sequence
  Synthetic oligonucleotide
gttactacggcgaattatcgtttta

SEQ ID NO: 735933 - DNA, 25 bp, Artificial sequence
  Synthetic oligonucleotide
agtataataatccgtcgtgttatgg

SEQ ID NO: 735934 - DNA, 25 bp, Artificial sequence
  Synthetic oligonucleotide
tagaatactatcctaacggactctt

SEQ ID NO: 735935 - DNA, 25 bp, Artificial sequence
  Synthetic oligonucleotide
aaagctactaatgcgacgtatatct

SEQ ID NO: 735936 - DNA, 25 bp, Artificial sequence
  Synthetic oligonucleotide
aaagctactaatccgacgtatatct

SEQ ID NO: 735937 - DNA, 25 bp, Artificial sequence
  Synthetic oligonucleotide
aaagtaacgttaatcgtcgattcca

SEQ ID NO: 735938 - DNA, 25 bp, Artificial sequence
  Synthetic oligonucleotide
aaagtaacgttattcgtcgattcca

SEQ ID NO: 735939 - DNA, 25 bp, Artificial sequence
  Synthetic oligonucleotide
tatcgaacgttaacgcgtaagatat

SEQ ID NO: 735940 - DNA, 25 bp, Artificial sequence
  Synthetic oligonucleotide
tatcgaacgttatcgcgtaagatat

SEQ ID NO: 735941 - DNA, 25 bp, Artificial sequence
  Synthetic oligonucleotide
cagttaacgttaacgcgttatatag

SEQ ID NO: 735942 - DNA, 25 bp, Artificial sequence
  Synthetic oligonucleotide
cagttaacgttatcgcgttatatag

SEQ ID NO: 735943 - DNA, 25 bp, Artificial sequence
  Synthetic oligonucleotide
caaattactatttcgcgctaaatcc

SEQ ID NO: 735944 - DNA, 25 bp, Artificial sequence
  Synthetic oligonucleotide
atttatacgtctagatacggtacga

SEQ ID NO: 735945 - DNA, 25 bp, Artificial sequence
  Synthetic oligonucleotide
caaattactattacgcgctaaatcc

SEQ ID NO: 735946 - DNA, 25 bp, Artificial sequence
  Synthetic oligonucleotide
gttactacggcgtattatcgtttta

SEQ ID NO: 735947 - DNA, 25 bp, Artificial sequence
  Synthetic oligonucleotide
tagaagacggacctaattctttgta

SEQ ID NO: 735948 - DNA, 25 bp, Artificial sequence
  Synthetic oligonucleotide
tagaagacggacgtaattctttgta

SEQ ID NO: 735949 - DNA, 25 bp, Artificial sequence
  Synthetic oligonucleotide
tttgacacgctatattcggacttaa

SEQ ID NO: 735950 - DNA, 25 bp, Artificial sequence
  Synthetic oligonucleotide
tttgacacgctaaattcggacttaa

SEQ ID NO: 735951 - DNA, 25 bp, Artificial sequence
  Synthetic oligonucleotide
taaatcacgcgttatctagtatgca

SEQ ID NO: 735952 - DNA, 25 bp, Artificial sequence
  Synthetic oligonucleotide
taaatcacgcgtaatctagtatgca

SEQ ID NO: 735953 - DNA, 25 bp, Artificial sequence
  Synthetic oligonucleotide
tgaattacgcgaatacgtttttgtc

SEQ ID NO: 735954 - DNA, 25 bp, Artificial sequence
  Synthetic oligonucleotide
tgaattacgcgattacgtttttgtc

SEQ ID NO: 735955 - DNA, 25 bp, Artificial sequence
  Synthetic oligonucleotide
aacagaacgcgaaaacgttatagta

SEQ ID NO: 735956 - DNA, 25 bp, Artificial sequence
  Synthetic oligonucleotide
atttatacgtcttgatacggtacga

SEQ ID NO: 735957 - DNA, 25 bp, Artificial sequence
  Synthetic oligonucleotide
caaaataggtcgtaatacgcatcat

SEQ ID NO: 735958 - DNA, 25 bp, Artificial sequence
  Synthetic oligonucleotide
aaaaacataataggcgtcgcaatag

SEQ ID NO: 735959 - DNA, 25 bp, Artificial sequence
  Synthetic oligonucleotide
taatggataagtatcgcgcactaaa

SEQ ID NO: 735960 - DNA, 25 bp, Artificial sequence
  Synthetic oligonucleotide
taatggataagtttcgcgcactaaa

SEQ ID NO: 735961 - DNA, 25 bp, Artificial sequence
  Synthetic oligonucleotide
ttatcaagtatactcgcgaaagaag

SEQ ID NO: 735962 - DNA, 25 bp, Artificial sequence
  Synthetic oligonucleotide
ttatcaagtatagtcgcgaaagaag

SEQ ID NO: 735963 - DNA, 25 bp, Artificial sequence
  Synthetic oligonucleotide
tacataagtacggtcgtaagttgtt

SEQ ID NO: 735964 - DNA, 25 bp, Artificial sequence
  Synthetic oligonucleotide
tacataagtacgctcgtaagttgtt

SEQ ID NO: 735965 - DNA, 25 bp, Artificial sequence
  Synthetic oligonucleotide
agtacaagtacgttttgcgttactt

SEQ ID NO: 735966 - DNA, 25 bp, Artificial sequence
  Synthetic oligonucleotide
agtacaagtacgatttgcgttactt

SEQ ID NO: 735967 - DNA, 25 bp, Artificial sequence
  Synthetic oligonucleotide
taaaggaggtcgtatcgttaattct

SEQ ID NO: 735968 - DNA, 25 bp, Artificial sequence
  Synthetic oligonucleotide
tagaatactatcgtaacggactctt

SEQ ID NO: 735969 - DNA, 25 bp, Artificial sequence
  Synthetic oligonucleotide
caaaataggtcgaaatacgcatcat

SEQ ID NO: 735970 - DNA, 25 bp, Artificial sequence
  Synthetic oligonucleotide
gtatttattaacccgctacccataa

SEQ ID NO: 735971 - DNA, 25 bp, Artificial sequence
  Synthetic oligonucleotide
ttactaaggtcgtttcgtagttctt

SEQ ID NO: 735972 - DNA, 25 bp, Artificial sequence
  Synthetic oligonucleotide
ttactaaggtcgattcgtagttctt

SEQ ID NO: 735973 - DNA, 25 bp, Artificial sequence
  Synthetic oligonucleotide
tataggaggcgacgtatatagttta

SEQ ID NO: 735974 - DNA, 25 bp, Artificial sequence
  Synthetic oligonucleotide
tataggaggcgaggtatatagttta

SEQ ID NO: 735975 - DNA, 25 bp, Artificial sequence
  Synthetic oligonucleotide
aagagtagctcgggtattagaaatt

SEQ ID NO: 735976 - DNA, 25 bp, Artificial sequence
  Synthetic oligonucleotide
aagagtagctcgcgtattagaaatt

SEQ ID NO: 735977 - DNA, 25 bp, Artificial sequence
  Synthetic oligonucleotide
gttaagagcgtctatacgagaaatt

SEQ ID NO: 735978 - DNA, 25 bp, Artificial sequence
  Synthetic oligonucleotide
gttaagagcgtcaatacgagaaatt

SEQ ID NO: 735979 - DNA, 25 bp, Artificial sequence
  Synthetic oligonucleotide
cgtgaaagattaacgcacgaataat

SEQ ID NO: 735980 - DNA, 25 bp, Artificial sequence
  Synthetic oligonucleotide
cgtgaaagattatcgcacgaataat

SEQ ID NO: 735981 - DNA, 25 bp, Artificial sequence
  Synthetic oligonucleotide
taaaggaggtcgaatcgttaattct

SEQ ID NO: 735982 - DNA, 25 bp, Artificial sequence
  Synthetic oligonucleotide
tgcggcggcaatggtgcgcaatgaa

SEQ ID NO: 735983 - DNA, 25 bp, Artificial sequence
  Synthetic oligonucleotide
cattgaaggccataaaactgctgcc

SEQ ID NO: 735984 - DNA, 25 bp, Artificial sequence
  Synthetic oligonucleotide
cgaacagctgggcgaagcgcctgat

SEQ ID NO: 735985 - DNA, 25 bp, Artificial sequence
  Synthetic oligonucleotide
cgaacagctgggggaagcgcctgat

SEQ ID NO: 735986 - DNA, 25 bp, Artificial sequence
  Synthetic oligonucleotide
cccggtcggaaaagctggaaacatc

SEQ ID NO: 735987 - DNA, 25 bp, Artificial sequence
  Synthetic oligonucleotide
cccggtcggaaatgctggaaacatc

SEQ ID NO: 735988 - DNA, 25 bp, Artificial sequence
  Synthetic oligonucleotide
gaagggcttcaacgaatatcatgag

SEQ ID NO: 735989 - DNA, 25 bp, Artificial sequence
  Synthetic oligonucleotide
gaagggcttcaaggaatatcatgag

SEQ ID NO: 735990 - DNA, 25 bp, Artificial sequence
  Synthetic oligonucleotide
aggccttccgaaaatgcgcggcttt

SEQ ID NO: 735991 - DNA, 25 bp, Artificial sequence
  Synthetic oligonucleotide
tccggaaacaatagcgacagccatt

SEQ ID NO: 735992 - DNA, 25 bp, Artificial sequence
  Synthetic oligonucleotide
tgcggcggcaatcgtgcgcaatgaa

SEQ ID NO: 735993 - DNA, 25 bp, Artificial sequence
  Synthetic oligonucleotide
tccggaaacaattgcgacagccatt

SEQ ID NO: 735994 - DNA, 25 bp, Artificial sequence
  Synthetic oligonucleotide
cattgaaggccaaaaaactgctgcc

SEQ ID NO: 735995 - DNA, 25 bp, Artificial sequence
  Synthetic oligonucleotide
catgaaatgcattgtcatcatcccg

SEQ ID NO: 735996 - DNA, 25 bp, Artificial sequence
  Synthetic oligonucleotide
aggccttccgaatatgcgcggcttt

SEQ ID NO: 735997 - DNA, 25 bp, Artificial sequence
  Synthetic oligonucleotide
accgattgcccttgtcaactcagtc

SEQ ID NO: 735998 - DNA, 25 bp, Artificial sequence
  Synthetic oligonucleotide
accgattgccctagtcaactcagtc

SEQ ID NO: 735999 - DNA, 25 bp, Artificial sequence
  Synthetic oligonucleotide
tgcgcttaaaattgtccgttccatc

SEQ ID NO: 736000 - DNA, 25 bp, Artificial sequence
  Synthetic oligonucleotide
tgcgcttaaaatagtccgttccatc

SEQ ID NO: 736001 - DNA, 25 bp, Artificial sequence
  Synthetic oligonucleotide
agccgagattatcgcaattgacgga

SEQ ID NO: 736002 - DNA, 25 bp, Artificial sequence
  Synthetic oligonucleotide
agccgagattatggcaattgacgga

SEQ ID NO: 736003 - DNA, 25 bp, Artificial sequence
  Synthetic oligonucleotide
cccggcaagctgcgacaaagctgta

SEQ ID NO: 736004 - DNA, 25 bp, Artificial sequence
  Synthetic oligonucleotide
tgcatttggaaatctcgctcaagct

SEQ ID NO: 736005 - DNA, 25 bp, Artificial sequence
  Synthetic oligonucleotide
tatcgcaggagtcctgaaacaggtg

SEQ ID NO: 736006 - DNA, 25 bp, Artificial sequence
  Synthetic oligonucleotide
catgaaatgcatagtcatcatcccg

SEQ ID NO: 736007 - DNA, 25 bp, Artificial sequence
  Synthetic oligonucleotide
ttccgctgctgccgcagcatatgca

SEQ ID NO: 736008 - DNA, 25 bp, Artificial sequence
  Synthetic oligonucleotide
ttccgctgctgcggcagcatatgca

SEQ ID NO: 736009 - DNA, 25 bp, Artificial sequence
  Synthetic oligonucleotide
caatgacacgataatgtgcgcgtca

SEQ ID NO: 736010 - DNA, 25 bp, Artificial sequence
  Synthetic oligonucleotide
caatgacacgattatgtgcgcgtca

SEQ ID NO: 736011 - DNA, 25 bp, Artificial sequence
  Synthetic oligonucleotide
tgcatttggaaaactcgctcaagct

SEQ ID NO: 736012 - DNA, 25 bp, Artificial sequence
  Synthetic oligonucleotide
catttcagaaatcaagcctgtcaca

SEQ ID NO: 736013 - DNA, 25 bp, Artificial sequence
  Synthetic oligonucleotide
accgcagatttgtacggaaaagaaa

SEQ ID NO: 736014 - DNA, 25 bp, Artificial sequence
  Synthetic oligonucleotide
ggtacagataacgtgatctaccaag

SEQ ID NO: 736015 - DNA, 25 bp, Artificial sequence
  Synthetic oligonucleotide
ggtacagataacctgatctaccaag

SEQ ID NO: 736016 - DNA, 25 bp, Artificial sequence
  Synthetic oligonucleotide
gaggctgaaacagaaacagtcgccg

SEQ ID NO: 736017 - DNA, 25 bp, Artificial sequence
  Synthetic oligonucleotide
gaggctgaaacacaaacagtcgccg

SEQ ID NO: 736018 - DNA, 25 bp, Artificial sequence
  Synthetic oligonucleotide
aagctgaccgtcattgaaagcgaca

SEQ ID NO: 736019 - DNA, 25 bp, Artificial sequence
  Synthetic oligonucleotide
aagctgaccgtctttgaaagcgaca

SEQ ID NO: 736020 - DNA, 25 bp, Artificial sequence
  Synthetic oligonucleotide
tttgattcagtccgaatggcgctca

SEQ ID NO: 736021 - DNA, 25 bp, Artificial sequence
  Synthetic oligonucleotide
tttgattcagtcggaatggcgctca

SEQ ID NO: 736022 - DNA, 25 bp, Artificial sequence
  Synthetic oligonucleotide
actgttcccggatgcacagctaacc

SEQ ID NO: 736023 - DNA, 25 bp, Artificial sequence
  Synthetic oligonucleotide
actgttcccggaagcacagctaacc

SEQ ID NO: 736024 - DNA, 25 bp, Artificial sequence
  Synthetic oligonucleotide
ccgtgtatgaaccaagccgacatgc

SEQ ID NO: 736025 - DNA, 25 bp, Artificial sequence
  Synthetic oligonucleotide
ccgtgtatgaacgaagccgacatgc

SEQ ID NO: 736026 - DNA, 25 bp, Artificial sequence
  Synthetic oligonucleotide
agaaggcgtgttagcagaaccaggt

SEQ ID NO: 736027 - DNA, 25 bp, Artificial sequence
  Synthetic oligonucleotide
tgtaacagatcaaacaccggcgcta

SEQ ID NO: 736028 - DNA, 25 bp, Artificial sequence
  Synthetic oligonucleotide
ggaatccaatgggaaaattgacgaa

SEQ ID NO: 736029 - DNA, 25 bp, Artificial sequence
  Synthetic oligonucleotide
ggaatccaatggcaaaattgacgaa

SEQ ID NO: 736030 - DNA, 25 bp, Artificial sequence
  Synthetic oligonucleotide
tgaaatccttcacgcatatcagctg

SEQ ID NO: 736031 - DNA, 25 bp, Artificial sequence
  Synthetic oligonucleotide
tgaaatccttcaggcatatcagctg

SEQ ID NO: 736032 - DNA, 25 bp, Artificial sequence
  Synthetic oligonucleotide
agaaggcgtgtttgcagaaccaggt

SEQ ID NO: 736033 - DNA, 25 bp, Artificial sequence
  Synthetic oligonucleotide
tgaagacagcatgcttgaatatgta

SEQ ID NO: 736034 - DNA, 25 bp, Artificial sequence
  Synthetic oligonucleotide
tatcgcaggagtgctgaaacaggtg

SEQ ID NO: 736035 - DNA, 25 bp, Artificial sequence
  Synthetic oligonucleotide
tgaagacagcatccttgaatatgta

SEQ ID NO: 736036 - DNA, 25 bp, Artificial sequence
  Synthetic oligonucleotide
aattccgaaaggcagcaaggtcgta

SEQ ID NO: 736037 - DNA, 25 bp, Artificial sequence
  Synthetic oligonucleotide
aattccgaaagggagcaaggtcgta

SEQ ID NO: 736038 - DNA, 25 bp, Artificial sequence
  Synthetic oligonucleotide
aggaaacggactcaaagatccgaac

SEQ ID NO: 736039 - DNA, 25 bp, Artificial sequence
  Synthetic oligonucleotide
aggaaacggactgaaagatccgaac

SEQ ID NO: 736040 - DNA, 25 bp, Artificial sequence
  Synthetic oligonucleotide
catttcagaaatgaagcctgtcaca

SEQ ID NO: 736041 - DNA, 25 bp, Artificial sequence
  Synthetic oligonucleotide
cccggcaagctgggacaaagctgta

SEQ ID NO: 736042 - DNA, 25 bp, Artificial sequence
  Synthetic oligonucleotide
aatggttatggcagtggcaaaggca

SEQ ID NO: 736043 - DNA, 25 bp, Artificial sequence
  Synthetic oligonucleotide
tggaagacgtcaaagtaaaggggat

SEQ ID NO: 736044 - DNA, 25 bp, Artificial sequence
  Synthetic oligonucleotide
tgccgacagcgacatccgttgtttc

SEQ ID NO: 736045 - DNA, 25 bp, Artificial sequence
  Synthetic oligonucleotide
gtgagacgatgtactacgggccggg

SEQ ID NO: 736046 - DNA, 25 bp, Artificial sequence
  Synthetic oligonucleotide
gtgagacgatgttctacgggccggg

SEQ ID NO: 736047 - DNA, 25 bp, Artificial sequence
  Synthetic oligonucleotide
agtttaacgctgattatgtatacgg

SEQ ID NO: 736048 - DNA, 25 bp, Artificial sequence
  Synthetic oligonucleotide
agtttaacgctgtttatgtatacgg

SEQ ID NO: 736049 - DNA, 25 bp, Artificial sequence
  Synthetic oligonucleotide
ttcctgaccatcatccgctttctgc

SEQ ID NO: 736050 - DNA, 25 bp, Artificial sequence
  Synthetic oligonucleotide
ttcctgaccatcttccgctttctgc

SEQ ID NO: 736051 - DNA, 25 bp, Artificial sequence
  Synthetic oligonucleotide
gcagcaaaatcgtggtcagcgtaca

SEQ ID NO: 736052 - DNA, 25 bp, Artificial sequence
  Synthetic oligonucleotide
gcagcaaaatcgaggtcagcgtaca

SEQ ID NO: 736053 - DNA, 25 bp, Artificial sequence
  Synthetic oligonucleotide
atacaatgaagctgatcgggattgc

SEQ ID NO: 736054 - DNA, 25 bp, Artificial sequence
  Synthetic oligonucleotide
atacaatgaagcagatcgggattgc

SEQ ID NO: 736055 - DNA, 25 bp, Artificial sequence
  Synthetic oligonucleotide
cagacgaggacaacagcttcagcaa

SEQ ID NO: 736056 - DNA, 25 bp, Artificial sequence
  Synthetic oligonucleotide
aggaaacacaccacttattcacctg

SEQ ID NO: 736057 - DNA, 25 bp, Artificial sequence
  Synthetic oligonucleotide
tggaagacgtcatagtaaaggggat

SEQ ID NO: 736058 - DNA, 25 bp, Artificial sequence
  Synthetic oligonucleotide
ctgtcatgaaaaatatgcgcctagg

SEQ ID NO: 736059 - DNA, 25 bp, Artificial sequence
  Synthetic oligonucleotide
tattggcgcgcctcggcttctcgat

SEQ ID NO: 736060 - DNA, 25 bp, Artificial sequence
  Synthetic oligonucleotide
tattggcgcgccacggcttctcgat

SEQ ID NO: 736061 - DNA, 25 bp, Artificial sequence
  Synthetic oligonucleotide
acgtggaagggcttgacgccgcacg

SEQ ID NO: 736062 - DNA, 25 bp, Artificial sequence
  Synthetic oligonucleotide
acgtggaagggcatgacgccgcacg

SEQ ID NO: 736063 - DNA, 25 bp, Artificial sequence
  Synthetic oligonucleotide
aggatctcggttttgccgaagctga

SEQ ID NO: 736064 - DNA, 25 bp, Artificial sequence
  Synthetic oligonucleotide
aggatctcggttatgccgaagctga

SEQ ID NO: 736065 - DNA, 25 bp, Artificial sequence
  Synthetic oligonucleotide
agaaaagcccatacgaggaagtgct

SEQ ID NO: 736066 - DNA, 25 bp, Artificial sequence
  Synthetic oligonucleotide
agaaaagcccattcgaggaagtgct

SEQ ID NO: 736067 - DNA, 25 bp, Artificial sequence
  Synthetic oligonucleotide
gcacaacaaactttatcttaaccaa

SEQ ID NO: 736068 - DNA, 25 bp, Artificial sequence
  Synthetic oligonucleotide
gcacaacaaactatatcttaaccaa

SEQ ID NO: 736069 - DNA, 25 bp, Artificial sequence
  Synthetic oligonucleotide
cagatcgaattacaaaaatgatggg

SEQ ID NO: 736070 - DNA, 25 bp, Artificial sequence
  Synthetic oligonucleotide
cagatcgaattagaaaaatgatggg

SEQ ID NO: 736071 - DNA, 25 bp, Artificial sequence
  Synthetic oligonucleotide
ttccgattctgcgcacgttagagga

SEQ ID NO: 736072 - DNA, 25 bp, Artificial sequence
  Synthetic oligonucleotide
cagacgaggacatcagcttcagcaa

SEQ ID NO: 736073 - DNA, 25 bp, Artificial sequence
  Synthetic oligonucleotide
catcagaagctgttttcagtgatat

SEQ ID NO: 736074 - DNA, 25 bp, Artificial sequence
  Synthetic oligonucleotide
aggcgtcaatcctacgggatcattt

SEQ ID NO: 736075 - DNA, 25 bp, Artificial sequence
  Synthetic oligonucleotide
aggcgtcaatccaacgggatcattt

SEQ ID NO: 736076 - DNA, 25 bp, Artificial sequence
  Synthetic oligonucleotide
tgagcagctcggtattgagcttcat

SEQ ID NO: 736077 - DNA, 25 bp, Artificial sequence
  Synthetic oligonucleotide
tgagcagctcggaattgagcttcat

SEQ ID NO: 736078 - DNA, 25 bp, Artificial sequence
  Synthetic oligonucleotide
aggaaacacacctcttattcacctg

SEQ ID NO: 736079 - DNA, 25 bp, Artificial sequence
  Synthetic oligonucleotide
accgcagatttgaacggaaaagaaa

SEQ ID NO: 736080 - DNA, 25 bp, Artificial sequence
  Synthetic oligonucleotide
tgtaacagatcatacaccggcgcta

SEQ ID NO: 736081 - DNA, 25 bp, Artificial sequence
  Synthetic oligonucleotide
gaaggacacccgcacaatgctggcg

SEQ ID NO: 736082 - DNA, 25 bp, Artificial sequence
  Synthetic oligonucleotide
gaaaggacttatgcatcaatataaa

SEQ ID NO: 736083 - DNA, 25 bp, Artificial sequence
  Synthetic oligonucleotide
gaaaggacttatccatcaatataaa

SEQ ID NO: 736084 - DNA, 25 bp, Artificial sequence
  Synthetic oligonucleotide
catatcgtgtagtagggaacggttg

SEQ ID NO: 736085 - DNA, 25 bp, Artificial sequence
  Synthetic oligonucleotide
catatcgtgtagaagggaacggttg

SEQ ID NO: 736086 - DNA, 25 bp, Artificial sequence
  Synthetic oligonucleotide
taaatgatttggaagtcgttcaaga

SEQ ID NO: 736087 - DNA, 25 bp, Artificial sequence
  Synthetic oligonucleotide
tgccgacagcgagatccgttgtttc

SEQ ID NO: 736088 - DNA, 25 bp, Artificial sequence
  Synthetic oligonucleotide
aaattacatctgagttctcagagcg

SEQ ID NO: 736089 - DNA, 25 bp, Artificial sequence
  Synthetic oligonucleotide
aatggttatggctgtggcaaaggca

SEQ ID NO: 736090 - DNA, 25 bp, Artificial sequence
  Synthetic oligonucleotide
acagctttgtcggaccgcaatatga

SEQ ID NO: 736091 - DNA, 25 bp, Artificial sequence
  Synthetic oligonucleotide
acagctttgtcgcaccgcaatatga

SEQ ID NO: 736092 - DNA, 25 bp, Artificial sequence
  Synthetic oligonucleotide
aatcgccgtctgtcatttatgcaca

SEQ ID NO: 736093 - DNA, 25 bp, Artificial sequence
  Synthetic oligonucleotide
aatcgccgtctgacatttatgcaca

SEQ ID NO: 736094 - DNA, 25 bp, Artificial sequence
  Synthetic oligonucleotide
taaatgatttggtagtcgttcaaga

SEQ ID NO: 736095 - DNA, 25 bp, Artificial sequence
  Synthetic oligonucleotide
gaattcatgtaatagatgaggttgg

SEQ ID NO: 736096 - DNA, 25 bp, Artificial sequence
  Synthetic oligonucleotide
catcagaagctgatttcagtgatat

SEQ ID NO: 736097 - DNA, 25 bp, Artificial sequence
  Synthetic oligonucleotide
aaattacatctgtgttctcagagcg

SEQ ID NO: 736098 - DNA, 25 bp, Artificial sequence
  Synthetic oligonucleotide
ttgaaaaaatccttcagctgccaat

SEQ ID NO: 736099 - DNA, 25 bp, Artificial sequence
  Synthetic oligonucleotide
ttgaaaaaatccatcagctgccaat

SEQ ID NO: 736100 - DNA, 25 bp, Artificial sequence
  Synthetic oligonucleotide
atgagttagctgtaatcgtaattgt

SEQ ID NO: 736101 - DNA, 25 bp, Artificial sequence
  Synthetic oligonucleotide
atgagttagctgaaatcgtaattgt

SEQ ID NO: 736102 - DNA, 25 bp, Artificial sequence
  Synthetic oligonucleotide
ctgtcatgaaaattatgcgcctagg

SEQ ID NO: 736103 - DNA, 25 bp, Artificial sequence
  Synthetic oligonucleotide
gaattcatgtaaaagatgaggttgg

SEQ ID NO: 736104 - DNA, 25 bp, Artificial sequence
  Synthetic oligonucleotide
agctgacaagtcacaaagctgatca

SEQ ID NO: 736105 - DNA, 25 bp, Artificial sequence
  Synthetic oligonucleotide
tctcaaaggcgtggctctatgatat

SEQ ID NO: 736106 - DNA, 25 bp, Artificial sequence
  Synthetic oligonucleotide
tctcaaaggcgtcgctctatgatat

SEQ ID NO: 736107 - DNA, 25 bp, Artificial sequence
  Synthetic oligonucleotide
tgcttggaaatgaaaaggaatataa

SEQ ID NO: 736108 - DNA, 25 bp, Artificial sequence
  Synthetic oligonucleotide
tgcttggaaatgtaaaggaatataa

SEQ ID NO: 736109 - DNA, 25 bp, Artificial sequence
  Synthetic oligonucleotide
caagctcattttgaccagacggaag

SEQ ID NO: 736110 - DNA, 25 bp, Artificial sequence
  Synthetic oligonucleotide
caagctcattttcaccagacggaag

SEQ ID NO: 736111 - DNA, 25 bp, Artificial sequence
  Synthetic oligonucleotide
ttaagcaggttacacctcatcgcgg

SEQ ID NO: 736112 - DNA, 25 bp, Artificial sequence
  Synthetic oligonucleotide
ttaagcaggttagacctcatcgcgg

SEQ ID NO: 736113 - DNA, 25 bp, Artificial sequence
  Synthetic oligonucleotide
atgatgtttacaaaatgtcactgga

SEQ ID NO: 736114 - DNA, 25 bp, Artificial sequence
  Synthetic oligonucleotide
atgatgtttacataatgtcactgga

SEQ ID NO: 736115 - DNA, 25 bp, Artificial sequence
  Synthetic oligonucleotide
ctaatttaactgaaacagatgatgc

SEQ ID NO: 736116 - DNA, 25 bp, Artificial sequence
  Synthetic oligonucleotide
ctaatttaactgtaacagatgatgc

SEQ ID NO: 736117 - DNA, 25 bp, Artificial sequence
  Synthetic oligonucleotide
gagaagcaagaaaactgactgatat

SEQ ID NO: 736118 - DNA, 25 bp, Artificial sequence
  Synthetic oligonucleotide
ctttttctcctgtcggcaaatggct

SEQ ID NO: 736119 - DNA, 25 bp, Artificial sequence
  Synthetic oligonucleotide
tagcggatgcgctgattggagattc

SEQ ID NO: 736120 - DNA, 25 bp, Artificial sequence
  Synthetic oligonucleotide
agctgacaagtctcaaagctgatca

SEQ ID NO: 736121 - DNA, 25 bp, Artificial sequence
  Synthetic oligonucleotide
ttgtgcttgtcaccgtaaagtcggg

SEQ ID NO: 736122 - DNA, 25 bp, Artificial sequence
  Synthetic oligonucleotide
ttgtgcttgtcagcgtaaagtcggg

SEQ ID NO: 736123 - DNA, 25 bp, Artificial sequence
  Synthetic oligonucleotide
acggcaaagggctgacgagaggtgc

SEQ ID NO: 736124 - DNA, 25 bp, Artificial sequence
  Synthetic oligonucleotide
acggcaaagggcagacgagaggtgc

SEQ ID NO: 736125 - DNA, 25 bp, Artificial sequence
  Synthetic oligonucleotide
aacctgttgaagtgcaaggcctctc

SEQ ID NO: 736126 - DNA, 25 bp, Artificial sequence
  Synthetic oligonucleotide
aacctgttgaagagcaaggcctctc

SEQ ID NO: 736127 - DNA, 25 bp, Artificial sequence
  Synthetic oligonucleotide
ttgatgaccgagaaaaaacagagca

SEQ ID NO: 736128 - DNA, 25 bp, Artificial sequence
  Synthetic oligonucleotide
ttgatgaccgagtaaaaacagagca

SEQ ID NO: 736129 - DNA, 25 bp, Artificial sequence
  Synthetic oligonucleotide
ttctggtcactaacagtttgggaga

SEQ ID NO: 736130 - DNA, 25 bp, Artificial sequence
  Synthetic oligonucleotide
ttctggtcactatcagtttgggaga

SEQ ID NO: 736131 - DNA, 25 bp, Artificial sequence
  Synthetic oligonucleotide
tgtcaaagccgctatggtccccgga

SEQ ID NO: 736132 - DNA, 25 bp, Artificial sequence
  Synthetic oligonucleotide
tctgaagcggactagctgcatttag

SEQ ID NO: 736133 - DNA, 25 bp, Artificial sequence
  Synthetic oligonucleotide
ctttttctcctgacggcaaatggct

SEQ ID NO: 736134 - DNA, 25 bp, Artificial sequence
  Synthetic oligonucleotide
gtgtgacaaagccggacagaccgag

SEQ ID NO: 736135 - DNA, 25 bp, Artificial sequence
  Synthetic oligonucleotide
gatacgcggtcgattatatcaatcc

SEQ ID NO: 736136 - DNA, 25 bp, Artificial sequence
  Synthetic oligonucleotide
catattttcatgtgtttcaggtgct

SEQ ID NO: 736137 - DNA, 25 bp, Artificial sequence
  Synthetic oligonucleotide
catattttcatgagtttcaggtgct

SEQ ID NO: 736138 - DNA, 25 bp, Artificial sequence
  Synthetic oligonucleotide
acatacacggcggtccgcatatgat

SEQ ID NO: 736139 - DNA, 25 bp, Artificial sequence
  Synthetic oligonucleotide
acatacacggcgctccgcatatgat

SEQ ID NO: 736140 - DNA, 25 bp, Artificial sequence
  Synthetic oligonucleotide
aaatggaaggtgtgacaacatatcc

SEQ ID NO: 736141 - DNA, 25 bp, Artificial sequence
  Synthetic oligonucleotide
aaatggaaggtgagacaacatatcc

SEQ ID NO: 736142 - DNA, 25 bp, Artificial sequence
  Synthetic oligonucleotide
gcgtgatggtgaacggctggctgat

SEQ ID NO: 736143 - DNA, 25 bp, Artificial sequence
  Synthetic oligonucleotide
gcgtgatggtgatcggctggctgat

SEQ ID NO: 736144 - DNA, 25 bp, Artificial sequence
  Synthetic oligonucleotide
caatacctgaagagattcaatatgc

SEQ ID NO: 736145 - DNA, 25 bp, Artificial sequence
  Synthetic oligonucleotide
caatacctgaagtgattcaatatgc

SEQ ID NO: 736146 - DNA, 25 bp, Artificial sequence
  Synthetic oligonucleotide
gcgcgaatgacatgtttgtcaggga

SEQ ID NO: 736147 - DNA, 25 bp, Artificial sequence
  Synthetic oligonucleotide
gcgcgaatgacaagtttgtcaggga

SEQ ID NO: 736148 - DNA, 25 bp, Artificial sequence
  Synthetic oligonucleotide
gcctcacatgtcttactgagatgct

SEQ ID NO: 736149 - DNA, 25 bp, Artificial sequence
  Synthetic oligonucleotide
cgggcatctattatatttcgattga

SEQ ID NO: 736150 - DNA, 25 bp, Artificial sequence
  Synthetic oligonucleotide
gagaagcaagaatactgactgatat

SEQ ID NO: 736151 - DNA, 25 bp, Artificial sequence
  Synthetic oligonucleotide
tagcggatgcgcagattggagattc

SEQ ID NO: 736152 - DNA, 25 bp, Artificial sequence
  Synthetic oligonucleotide
gtgctgaacagcgcccgatttggac

SEQ ID NO: 736153 - DNA, 25 bp, Artificial sequence
  Synthetic oligonucleotide
gtgctgaacagcccccgatttggac

SEQ ID NO: 736154 - DNA, 25 bp, Artificial sequence
  Synthetic oligonucleotide
aagggttttatgtcatcggcacaga

SEQ ID NO: 736155 - DNA, 25 bp, Artificial sequence
  Synthetic oligonucleotide
gtatcccgcttgcacaggaagagaa

SEQ ID NO: 736156 - DNA, 25 bp, Artificial sequence
  Synthetic oligonucleotide
cgggcatctattttatttcgattga

SEQ ID NO: 736157 - DNA, 25 bp, Artificial sequence
  Synthetic oligonucleotide
gtatcccgcttggacaggaagagaa

SEQ ID NO: 736158 - DNA, 25 bp, Artificial sequence
  Synthetic oligonucleotide
atccgattcgtctggaaaaagagta

SEQ ID NO: 736159 - DNA, 25 bp, Artificial sequence
  Synthetic oligonucleotide
atccgattcgtcaggaaaaagagta

SEQ ID NO: 736160 - DNA, 25 bp, Artificial sequence
  Synthetic oligonucleotide
tttctctttcacgtgatgaacagca

SEQ ID NO: 736161 - DNA, 25 bp, Artificial sequence
  Synthetic oligonucleotide
tttctctttcacctgatgaacagca

SEQ ID NO: 736162 - DNA, 25 bp, Artificial sequence
  Synthetic oligonucleotide
gtgtgacaaagcgggacagaccgag

SEQ ID NO: 736163 - DNA, 25 bp, Artificial sequence
  Synthetic oligonucleotide
gcctcacatgtcatactgagatgct

SEQ ID NO: 736164 - DNA, 25 bp, Artificial sequence
  Synthetic oligonucleotide
aagggttttatgacatcggcacaga

SEQ ID NO: 736165 - DNA, 25 bp, Artificial sequence
  Synthetic oligonucleotide
gtagtcgttgtctttcctttttatg

SEQ ID NO: 736166 - DNA, 25 bp, Artificial sequence
  Synthetic oligonucleotide
ggaacggctctcagcggagcaggcc

SEQ ID NO: 736167 - DNA, 25 bp, Artificial sequence
  Synthetic oligonucleotide
aaagtagagcacctcgccgagatga

SEQ ID NO: 736168 - DNA, 25 bp, Artificial sequence
  Synthetic oligonucleotide
aaagtagagcacgtcgccgagatga

SEQ ID NO: 736169 - DNA, 25 bp, Artificial sequence
  Synthetic oligonucleotide
cagccgtaccgggcgatgcttgtgc

SEQ ID NO: 736170 - DNA, 25 bp, Artificial sequence
  Synthetic oligonucleotide
cagccgtaccggccgatgcttgtgc

SEQ ID NO: 736171 - DNA, 25 bp, Artificial sequence
  Synthetic oligonucleotide
cttgtcgggaaattcatgaagaagg

SEQ ID NO: 736172 - DNA, 25 bp, Artificial sequence
  Synthetic oligonucleotide
cttgtcgggaaaatcatgaagaagg

SEQ ID NO: 736173 - DNA, 25 bp, Artificial sequence
  Synthetic oligonucleotide
atcctcattgctgcgatcatgtcca

SEQ ID NO: 736174 - DNA, 25 bp, Artificial sequence
  Synthetic oligonucleotide
atcctcattgctccgatcatgtcca

SEQ ID NO: 736175 - DNA, 25 bp, Artificial sequence
  Synthetic oligonucleotide
tatgccgatgccgtaaaagcaagtg

SEQ ID NO: 736176 - DNA, 25 bp, Artificial sequence
  Synthetic oligonucleotide
tatgccgatgccctaaaagcaagtg

SEQ ID NO: 736177 - DNA, 25 bp, Artificial sequence
  Synthetic oligonucleotide
agagacgcgagagacgtgcttccga

SEQ ID NO: 736178 - DNA, 25 bp, Artificial sequence
  Synthetic oligonucleotide
tgtcaaagccgcaatggtccccgga

SEQ ID NO: 736179 - DNA, 25 bp, Artificial sequence
  Synthetic oligonucleotide
gtagtcgttgtcattcctttttatg

SEQ ID NO: 736180 - DNA, 25 bp, Artificial sequence
  Synthetic oligonucleotide
gtcatgaccgaaaaaggaaagggag

SEQ ID NO: 736181 - DNA, 25 bp, Artificial sequence
  Synthetic oligonucleotide
acccaaatgatcggcgtcccgaatg

SEQ ID NO: 736182 - DNA, 25 bp, Artificial sequence
  Synthetic oligonucleotide
acccaaatgatccgcgtcccgaatg

SEQ ID NO: 736183 - DNA, 25 bp, Artificial sequence
  Synthetic oligonucleotide
ggcggacttgtgatcggcctgcatg

SEQ ID NO: 736184 - DNA, 25 bp, Artificial sequence
  Synthetic oligonucleotide
ggcggacttgtgttcggcctgcatg

SEQ ID NO: 736185 - DNA, 25 bp, Artificial sequence
  Synthetic oligonucleotide
gaaggacacccggacaatgctggcg

SEQ ID NO: 736186 - DNA, 25 bp, Artificial sequence
  Synthetic oligonucleotide
gatacgcggtcgtttatatcaatcc

SEQ ID NO: 736187 - DNA, 25 bp, Artificial sequence
  Synthetic oligonucleotide
tctgaagcggacaagctgcatttag

SEQ ID NO: 736188 - DNA, 25 bp, Artificial sequence
  Synthetic oligonucleotide
ttccgattctgcccacgttagagga

SEQ ID NO: 736189 - DNA, 25 bp, Artificial sequence
  Synthetic oligonucleotide
attgaactggctgatgaattatgcg

SEQ ID NO: 736190 - DNA, 25 bp, Artificial sequence
  Synthetic oligonucleotide
attgaactggctcatgaattatgcg

SEQ ID NO: 736191 - DNA, 25 bp, Artificial sequence
  Synthetic oligonucleotide
ggccttggcagcagcgccgcagcga

SEQ ID NO: 736192 - DNA, 25 bp, Artificial sequence
  Synthetic oligonucleotide
ggccttggcagctgcgccgcagcga

SEQ ID NO: 736193 - DNA, 25 bp, Artificial sequence
  Synthetic oligonucleotide
catgtgaaggtgtggagcgacatcc

SEQ ID NO: 736194 - DNA, 25 bp, Artificial sequence
  Synthetic oligonucleotide
agagacgcgagacacgtgcttccga

SEQ ID NO: 736195 - DNA, 25 bp, Artificial sequence
  Synthetic oligonucleotide
aaaagctgataaccgcagacgacat

SEQ ID NO: 736196 - DNA, 25 bp, Artificial sequence
  Synthetic oligonucleotide
atgcggcacagcattatatcatgag

SEQ ID NO: 736197 - DNA, 25 bp, Artificial sequence
  Synthetic oligonucleotide
atgcggcacagctttatatcatgag

SEQ ID NO: 736198 - DNA, 25 bp, Artificial sequence
  Synthetic oligonucleotide
ggcgcacgcttgcctttatttctga

SEQ ID NO: 736199 - DNA, 25 bp, Artificial sequence
  Synthetic oligonucleotide
ggcgcacgcttggctttatttctga

SEQ ID NO: 736200 - DNA, 25 bp, Artificial sequence
  Synthetic oligonucleotide
aaaagcgaagcagcgacccaagatg

SEQ ID NO: 736201 - DNA, 25 bp, Artificial sequence
  Synthetic oligonucleotide
aaaagcgaagcaccgacccaagatg

SEQ ID NO: 736202 - DNA, 25 bp, Artificial sequence
  Synthetic oligonucleotide
cgaaaacgggagcatctgttccttg

SEQ ID NO: 736203 - DNA, 25 bp, Artificial sequence
  Synthetic oligonucleotide
cgaaaacgggaggatctgttccttg

SEQ ID NO: 736204 - DNA, 25 bp, Artificial sequence
  Synthetic oligonucleotide
agaaagattcgtatacatcaaatat

SEQ ID NO: 736205 - DNA, 25 bp, Artificial sequence
  Synthetic oligonucleotide
agaaagattcgtttacatcaaatat

SEQ ID NO: 736206 - DNA, 25 bp, Artificial sequence
  Synthetic oligonucleotide
cccgtgccgcatttgtaaaatcaca

SEQ ID NO: 736207 - DNA, 25 bp, Artificial sequence
  Synthetic oligonucleotide
cccgtgccgcatatgtaaaatcaca

SEQ ID NO: 736208 - DNA, 25 bp, Artificial sequence
  Synthetic oligonucleotide
tctctgtgaccgatcctcaatacgc

SEQ ID NO: 736209 - DNA, 25 bp, Artificial sequence
  Synthetic oligonucleotide
ggaacggctctctgcggagcaggcc

SEQ ID NO: 736210 - DNA, 25 bp, Artificial sequence
  Synthetic oligonucleotide
atcatgccaagcgttcctcagcgtc

SEQ ID NO: 736211 - DNA, 25 bp, Artificial sequence
  Synthetic oligonucleotide
catgtgaaggtgaggagcgacatcc

SEQ ID NO: 736212 - DNA, 25 bp, Artificial sequence
  Synthetic oligonucleotide
gaacagctcgcgcttcatttccctc

SEQ ID NO: 736213 - DNA, 25 bp, Artificial sequence
  Synthetic oligonucleotide
gaacagctcgcggttcatttccctc

SEQ ID NO: 736214 - DNA, 25 bp, Artificial sequence
  Synthetic oligonucleotide
gacgctttgacccttccgaaagagg

SEQ ID NO: 736215 - DNA, 25 bp, Artificial sequence
  Synthetic oligonucleotide
gacgctttgaccgttccgaaagagg

SEQ ID NO: 736216 - DNA, 25 bp, Artificial sequence
  Synthetic oligonucleotide
tctctgtgaccgttcctcaatacgc

SEQ ID NO: 736217 - DNA, 25 bp, Artificial sequence
  Synthetic oligonucleotide
gagcgaaatcctatatatcaagtaa

SEQ ID NO: 736218 - DNA, 25 bp, Artificial sequence
  Synthetic oligonucleotide
aaaagctgataagcgcagacgacat

SEQ ID NO: 736219 - DNA, 25 bp, Artificial sequence
  Synthetic oligonucleotide
atcatgccaagccttcctcagcgtc

SEQ ID NO: 736220 - DNA, 25 bp, Artificial sequence
  Synthetic oligonucleotide
cttttttttgctggagataaaggag

SEQ ID NO: 736221 - DNA, 25 bp, Artificial sequence
  Synthetic oligonucleotide
cttttttttgctcgagataaaggag

SEQ ID NO: 736222 - DNA, 25 bp, Artificial sequence
  Synthetic oligonucleotide
aacgaaatacatgtaaaaaggagga

SEQ ID NO: 736223 - DNA, 25 bp, Artificial sequence
  Synthetic oligonucleotide
aacgaaatacatctaaaaaggagga

SEQ ID NO: 736224 - DNA, 25 bp, Artificial sequence
  Synthetic oligonucleotide
gtcatgaccgaataaggaaagggag

SEQ ID NO: 736225 - DNA, 25 bp, Artificial sequence
  Synthetic oligonucleotide
gagcgaaatcctttatatcaagtaa

SEQ ID NO: 736226 - DNA, 25 bp, Artificial sequence
  Synthetic oligonucleotide
caaaacaggagcgggcttatataat

SEQ ID NO: 736227 - DNA, 25 bp, Artificial sequence
  Synthetic oligonucleotide
ggaagcggtgtccttaaaattattc

SEQ ID NO: 736228 - DNA, 25 bp, Artificial sequence
  Synthetic oligonucleotide
ggaagcggtgtcgttaaaattattc

SEQ ID NO: 736229 - DNA, 25 bp, Artificial sequence
  Synthetic oligonucleotide
gcgattcgtgtacggcttttaggtt

SEQ ID NO: 736230 - DNA, 25 bp, Artificial sequence
  Synthetic oligonucleotide
gcgattcgtgtagggcttttaggtt

SEQ ID NO: 736231 - DNA, 25 bp, Artificial sequence
  Synthetic oligonucleotide
gaggacaatcaatagaaaggtggag

SEQ ID NO: 736232 - DNA, 25 bp, Artificial sequence
  Synthetic oligonucleotide
gaggacaatcaaaagaaaggtggag

SEQ ID NO: 736233 - DNA, 25 bp, Artificial sequence
  Synthetic oligonucleotide
gataagcttatgcatcaggtcggct

SEQ ID NO: 736234 - DNA, 25 bp, Artificial sequence
  Synthetic oligonucleotide
atatgtctgtgttgagttaacaatt

SEQ ID NO: 736235 - DNA, 25 bp, Artificial sequence
  Synthetic oligonucleotide
tttacattcgcaaaattcagcctaa

SEQ ID NO: 736236 - DNA, 25 bp, Artificial sequence
  Synthetic oligonucleotide
caaaacaggagccggcttatataat

SEQ ID NO: 736237 - DNA, 25 bp, Artificial sequence
  Synthetic oligonucleotide
tttacattcgcataattcagcctaa

SEQ ID NO: 736238 - DNA, 25 bp, Artificial sequence
  Synthetic oligonucleotide
aaaataaagaatgttgtcatatcaa

SEQ ID NO: 736239 - DNA, 25 bp, Artificial sequence
  Synthetic oligonucleotide
ctcaaggtgaggagaaaatctgaca

SEQ ID NO: 736240 - DNA, 25 bp, Artificial sequence
  Synthetic oligonucleotide
ctcaaggtgaggtgaaaatctgaca

SEQ ID NO: 736241 - DNA, 25 bp, Artificial sequence
  Synthetic oligonucleotide
gcgatatctactatgaagccagtgt

SEQ ID NO: 736242 - DNA, 25 bp, Artificial sequence
  Synthetic oligonucleotide
atatgtctgtgtagagttaacaatt

SEQ ID NO: 736243 - DNA, 25 bp, Artificial sequence
  Synthetic oligonucleotide
gctccgagctgcttgccgaagcgaa

SEQ ID NO: 736244 - DNA, 25 bp, Artificial sequence
  Synthetic oligonucleotide
aaaataaagaatcttgtcatatcaa

SEQ ID NO: 736245 - DNA, 25 bp, Artificial sequence
  Synthetic oligonucleotide
gataagcttatggatcaggtcggct

SEQ ID NO: 736246 - DNA, 25 bp, Artificial sequence
  Synthetic oligonucleotide
gcgatatctactttgaagccagtgt

SEQ ID NO: 736247 - DNA, 25 bp, Artificial sequence
  Synthetic oligonucleotide
gctccgagctgcatgccgaagcgaa

SEQ ID NO: 736248 - DNA, 25 bp, Artificial sequence
  Synthetic oligonucleotide
ttgtcacagcaatcaaggacttaat

SEQ ID NO: 736249 - DNA, 25 bp, Artificial sequence
  Synthetic oligonucleotide
ttgtcacagcaaacaaggacttaat

SEQ ID NO: 736250 - DNA, 25 bp, Artificial sequence
  Synthetic oligonucleotide
aatatttggtcgacgcgctgagatc

SEQ ID NO: 736251 - DNA, 25 bp, Artificial sequence
  Synthetic oligonucleotide
aatatttggtcgtcgcgctgagatc

SEQ ID NO: 736252 - DNA, 25 bp, Artificial sequence
  Synthetic oligonucleotide
aagtagatttgcggaaggaagtgct

SEQ ID NO: 736253 - DNA, 25 bp, Artificial sequence
  Synthetic oligonucleotide
tcatcgaggtgatcggcggcgttga

SEQ ID NO: 736254 - DNA, 25 bp, Artificial sequence
  Synthetic oligonucleotide
tgtatgatgtcaatgatgatccaga

SEQ ID NO: 736255 - DNA, 25 bp, Artificial sequence
  Synthetic oligonucleotide
tgtatgatgtcattgatgatccaga

SEQ ID NO: 736256 - DNA, 25 bp, Artificial sequence
  Synthetic oligonucleotide
aagtagatttgccgaaggaagtgct

SEQ ID NO: 736257 - DNA, 25 bp, Artificial sequence
  Synthetic oligonucleotide
tcatcgaggtgaacggcggcgttga

SEQ ID NO: 736258 - DNA, 25 bp, Artificial sequence
  Synthetic oligonucleotide
aaaaagtgcttgaaaaagatttaga

SEQ ID NO: 736259 - DNA, 25 bp, Artificial sequence
  Synthetic oligonucleotide
aaaaagtgcttgtaaaagatttaga

SEQ ID NO: 736260 - DNA, 25 bp, Artificial sequence
  Synthetic oligonucleotide
aactcgagccaagaccgagagagac

SEQ ID NO: 736261 - DNA, 25 bp, Artificial sequence
  Synthetic oligonucleotide
gtattgcctacattgggtttgacgg

SEQ ID NO: 736262 - DNA, 25 bp, Artificial sequence
  Synthetic oligonucleotide
gtattgcctacaatgggtttgacgg

SEQ ID NO: 736263 - DNA, 25 bp, Artificial sequence
  Synthetic oligonucleotide
cttgtattacgaatcgcacgatgag

SEQ ID NO: 736264 - DNA, 25 bp, Artificial sequence
  Synthetic oligonucleotide
cttgtattacgattcgcacgatgag

SEQ ID NO: 736265 - DNA, 25 bp, Artificial sequence
  Synthetic oligonucleotide
gtgttgcatcgaaacaggcaggtgc

SEQ ID NO: 736266 - DNA, 25 bp, Artificial sequence
  Synthetic oligonucleotide
gtaataaagccggtgcgctgctgaa

SEQ ID NO: 736267 - DNA, 25 bp, Artificial sequence
  Synthetic oligonucleotide
ctgattctgttcgggaagccgaata

SEQ ID NO: 736268 - DNA, 25 bp, Artificial sequence
  Synthetic oligonucleotide
ctgattctgttccggaagccgaata

SEQ ID NO: 736269 - DNA, 25 bp, Artificial sequence
  Synthetic oligonucleotide
aactcgagccaacaccgagagagac

SEQ ID NO: 736270 - DNA, 25 bp, Artificial sequence
  Synthetic oligonucleotide
atggttctgtttctgtgccggagtt

SEQ ID NO: 736271 - DNA, 25 bp, Artificial sequence
  Synthetic oligonucleotide
gtaataaagccgctgcgctgctgaa

SEQ ID NO: 736272 - DNA, 25 bp, Artificial sequence
  Synthetic oligonucleotide
gtgttgcatcgatacaggcaggtgc

SEQ ID NO: 736273 - DNA, 25 bp, Artificial sequence
  Synthetic oligonucleotide
gcgcacccaaaaaccgtgccatgca

SEQ ID NO: 736274 - DNA, 25 bp, Artificial sequence
  Synthetic oligonucleotide
gcgcacccaaaatccgtgccatgca

SEQ ID NO: 736275 - DNA, 25 bp, Artificial sequence
  Synthetic oligonucleotide
cactgatgtctgctttcccggcggg

SEQ ID NO: 736276 - DNA, 25 bp, Artificial sequence
  Synthetic oligonucleotide
cactgatgtctggtttcccggcggg

SEQ ID NO: 736277 - DNA, 25 bp, Artificial sequence
  Synthetic oligonucleotide
caggccgattgaaaaaaggggttca

SEQ ID NO: 736278 - DNA, 25 bp, Artificial sequence
  Synthetic oligonucleotide
caggccgattgataaaaggggttca

SEQ ID NO: 736279 - DNA, 25 bp, Artificial sequence
  Synthetic oligonucleotide
tttccttttcacatgtcatgcacat

SEQ ID NO: 736280 - DNA, 25 bp, Artificial sequence
  Synthetic oligonucleotide
atggttctgtttgtgtgccggagtt

SEQ ID NO: 736281 - DNA, 25 bp, Artificial sequence
  Synthetic oligonucleotide
atcttgcccgaatcgatatcggcag

SEQ ID NO: 736282 - DNA, 25 bp, Artificial sequence
  Synthetic oligonucleotide
atcttgcccgaaacgatatcggcag

SEQ ID NO: 736283 - DNA, 25 bp, Artificial sequence
  Synthetic oligonucleotide
atgaaaaagaaatagcggagcatta

SEQ ID NO: 736284 - DNA, 25 bp, Artificial sequence
  Synthetic oligonucleotide
ttgcagaagacatgtttcatagcaa

SEQ ID NO: 736285 - DNA, 25 bp, Artificial sequence
  Synthetic oligonucleotide
gttgcctcggcacctggtgcgaaaa

SEQ ID NO: 736286 - DNA, 25 bp, Artificial sequence
  Synthetic oligonucleotide
tttccttttcacttgtcatgcacat

SEQ ID NO: 736287 - DNA, 25 bp, Artificial sequence
  Synthetic oligonucleotide
gatattgttgatacatgcggaacag

SEQ ID NO: 736288 - DNA, 25 bp, Artificial sequence
  Synthetic oligonucleotide
aacatgggatttgtttttgcgccgc

SEQ ID NO: 736289 - DNA, 25 bp, Artificial sequence
  Synthetic oligonucleotide
aacatgggatttctttttgcgccgc

SEQ ID NO: 736290 - DNA, 25 bp, Artificial sequence
  Synthetic oligonucleotide
actcccgaaaaggtcaaaagcagca

SEQ ID NO: 736291 - DNA, 25 bp, Artificial sequence
  Synthetic oligonucleotide
actcccgaaaagctcaaaagcagca

SEQ ID NO: 736292 - DNA, 25 bp, Artificial sequence
  Synthetic oligonucleotide
gatgttttagaggagctagaggttt

SEQ ID NO: 736293 - DNA, 25 bp, Artificial sequence
  Synthetic oligonucleotide
gatgttttagagcagctagaggttt

SEQ ID NO: 736294 - DNA, 25 bp, Artificial sequence
  Synthetic oligonucleotide
ggcaatcgctctgtctcttctaaaa

SEQ ID NO: 736295 - DNA, 25 bp, Artificial sequence
  Synthetic oligonucleotide
ggcaatcgctctctctcttctaaaa

SEQ ID NO: 736296 - DNA, 25 bp, Artificial sequence
  Synthetic oligonucleotide
atgaaaaatcgggttttatggctga

SEQ ID NO: 736297 - DNA, 25 bp, Artificial sequence
  Synthetic oligonucleotide
gttgcctcggcagctggtgcgaaaa

SEQ ID NO: 736298 - DNA, 25 bp, Artificial sequence
  Synthetic oligonucleotide
atgaaaaagaaaaagcggagcatta

SEQ ID NO: 736299 - DNA, 25 bp, Artificial sequence
  Synthetic oligonucleotide
atttccacttttaatatctcaacgc

SEQ ID NO: 736300 - DNA, 25 bp, Artificial sequence
  Synthetic oligonucleotide
gatattgttgattcatgcggaacag

SEQ ID NO: 736301 - DNA, 25 bp, Artificial sequence
  Synthetic oligonucleotide
ttgcagaagacaagtttcatagcaa

SEQ ID NO: 736302 - DNA, 25 bp, Artificial sequence
  Synthetic oligonucleotide
atgcgggcacacgctcttacagtcg

SEQ ID NO: 736303 - DNA, 25 bp, Artificial sequence
  Synthetic oligonucleotide
atgcgggcacaccctcttacagtcg

SEQ ID NO: 736304 - DNA, 25 bp, Artificial sequence
  Synthetic oligonucleotide
gagacgccagaagagcttgcgggtt

SEQ ID NO: 736305 - DNA, 25 bp, Artificial sequence
  Synthetic oligonucleotide
gagacgccagaacagcttgcgggtt

SEQ ID NO: 736306 - DNA, 25 bp, Artificial sequence
  Synthetic oligonucleotide
atgggggggatattgtcaattcttg

SEQ ID NO: 736307 - DNA, 25 bp, Artificial sequence
  Synthetic oligonucleotide
atgggggggataatgtcaattcttg

SEQ ID NO: 736308 - DNA, 25 bp, Artificial sequence
  Synthetic oligonucleotide
aatatgatgatggcagcggaaatga

SEQ ID NO: 736309 - DNA, 25 bp, Artificial sequence
  Synthetic oligonucleotide
aatatgatgatgccagcggaaatga

SEQ ID NO: 736310 - DNA, 25 bp, Artificial sequence
  Synthetic oligonucleotide
aaaacccttactcccggtgaggctg

SEQ ID NO: 736311 - DNA, 25 bp, Artificial sequence
  Synthetic oligonucleotide
aaaacccttactgccggtgaggctg

SEQ ID NO: 736312 - DNA, 25 bp, Artificial sequence
  Synthetic oligonucleotide
ctgatgaacagatttctacaattgt

SEQ ID NO: 736313 - DNA, 25 bp, Artificial sequence
  Synthetic oligonucleotide
ctgatgaacagaattctacaattgt

SEQ ID NO: 736314 - DNA, 25 bp, Artificial sequence
  Synthetic oligonucleotide
atttccactttttatatctcaacgc

SEQ ID NO: 736315 - DNA, 25 bp, Artificial sequence
  Synthetic oligonucleotide
acaattaaagaagagcagggccgtt

SEQ ID NO: 736316 - DNA, 25 bp, Artificial sequence
  Synthetic oligonucleotide
tcaaaagctataaaaaagcaggcga

SEQ ID NO: 736317 - DNA, 25 bp, Artificial sequence
  Synthetic oligonucleotide
gaaacagacatgcaaaagtgtatgc

SEQ ID NO: 736318 - DNA, 25 bp, Artificial sequence
  Synthetic oligonucleotide
gaaacagacatggaaaagtgtatgc

SEQ ID NO: 736319 - DNA, 25 bp, Artificial sequence
  Synthetic oligonucleotide
ccgctgattgaggcttctgttcctt

SEQ ID NO: 736320 - DNA, 25 bp, Artificial sequence
  Synthetic oligonucleotide
ccgctgattgagccttctgttcctt

SEQ ID NO: 736321 - DNA, 25 bp, Artificial sequence
  Synthetic oligonucleotide
ggcggagctgtccggtacttaagct

SEQ ID NO: 736322 - DNA, 25 bp, Artificial sequence
  Synthetic oligonucleotide
ggcggagctgtcgggtacttaagct

SEQ ID NO: 736323 - DNA, 25 bp, Artificial sequence
  Synthetic oligonucleotide
aaaatcaaaacagctgagcttggca

SEQ ID NO: 736324 - DNA, 25 bp, Artificial sequence
  Synthetic oligonucleotide
aaaatcaaaacacctgagcttggca

SEQ ID NO: 736325 - DNA, 25 bp, Artificial sequence
  Synthetic oligonucleotide
ctaaaagaagtggtgaactggatga

SEQ ID NO: 736326 - DNA, 25 bp, Artificial sequence
  Synthetic oligonucleotide
ctaaaagaagtgctgaactggatga

SEQ ID NO: 736327 - DNA, 25 bp, Artificial sequence
  Synthetic oligonucleotide
cggacattaattgcgtatgatcatg

SEQ ID NO: 736328 - DNA, 25 bp, Artificial sequence
  Synthetic oligonucleotide
gatcaggacagctaatctctttaca

SEQ ID NO: 736329 - DNA, 25 bp, Artificial sequence
  Synthetic oligonucleotide
gtccactttatccaatatgcaaggc

SEQ ID NO: 736330 - DNA, 25 bp, Artificial sequence
  Synthetic oligonucleotide
acaattaaagaacagcagggccgtt

SEQ ID NO: 736331 - DNA, 25 bp, Artificial sequence
  Synthetic oligonucleotide
tccagatattcgattatcggcctga

SEQ ID NO: 736332 - DNA, 25 bp, Artificial sequence
  Synthetic oligonucleotide
tccagatattcgtttatcggcctga

SEQ ID NO: 736333 - DNA, 25 bp, Artificial sequence
  Synthetic oligonucleotide
tatcttcttgaaagcaaggacgata

SEQ ID NO: 736334 - DNA, 25 bp, Artificial sequence
  Synthetic oligonucleotide
tatcttcttgaatgcaaggacgata

SEQ ID NO: 736335 - DNA, 25 bp, Artificial sequence
  Synthetic oligonucleotide
attcaaatgatagagaagcttgaca

SEQ ID NO: 736336 - DNA, 25 bp, Artificial sequence
  Synthetic oligonucleotide
attcaaatgatacagaagcttgaca

SEQ ID NO: 736337 - DNA, 25 bp, Artificial sequence
  Synthetic oligonucleotide
attgtggagaccttcacagtcgata

SEQ ID NO: 736338 - DNA, 25 bp, Artificial sequence
  Synthetic oligonucleotide
attgtggagaccatcacagtcgata

SEQ ID NO: 736339 - DNA, 25 bp, Artificial sequence
  Synthetic oligonucleotide
tttttagaggacagcttgtcccacc

SEQ ID NO: 736340 - DNA, 25 bp, Artificial sequence
  Synthetic oligonucleotide
tttttagaggactgcttgtcccacc

SEQ ID NO: 736341 - DNA, 25 bp, Artificial sequence
  Synthetic oligonucleotide
gtgagagcaatgtatttccaatcaa

SEQ ID NO: 736342 - DNA, 25 bp, Artificial sequence
  Synthetic oligonucleotide
gatcaggacagcaaatctctttaca

SEQ ID NO: 736343 - DNA, 25 bp, Artificial sequence
  Synthetic oligonucleotide
tcaaaagctatataaaagcaggcga

SEQ ID NO: 736344 - DNA, 25 bp, Artificial sequence
  Synthetic oligonucleotide
ctgaagatgagacactgaaggttga

SEQ ID NO: 736345 - DNA, 25 bp, Artificial sequence
  Synthetic oligonucleotide
cgattgccggtaggagaaaacgcgg

SEQ ID NO: 736346 - DNA, 25 bp, Artificial sequence
  Synthetic oligonucleotide
cgattgccggtacgagaaaacgcgg

SEQ ID NO: 736347 - DNA, 25 bp, Artificial sequence
  Synthetic oligonucleotide
taatacacgttcaagacgggcactt

SEQ ID NO: 736348 - DNA, 25 bp, Artificial sequence
  Synthetic oligonucleotide
taatacacgttctagacgggcactt

SEQ ID NO: 736349 - DNA, 25 bp, Artificial sequence
  Synthetic oligonucleotide
tagacagagaaaaagtcggcagctc

SEQ ID NO: 736350 - DNA, 25 bp, Artificial sequence
  Synthetic oligonucleotide
tagacagagaaatagtcggcagctc

SEQ ID NO: 736351 - DNA, 25 bp, Artificial sequence
  Synthetic oligonucleotide
tcaatccttcgcggtatatgtatta

SEQ ID NO: 736352 - DNA, 25 bp, Artificial sequence
  Synthetic oligonucleotide
tcaatccttcgccgtatatgtatta

SEQ ID NO: 736353 - DNA, 25 bp, Artificial sequence
  Synthetic oligonucleotide
cagatgcttttgagttataccgagt

SEQ ID NO: 736354 - DNA, 25 bp, Artificial sequence
  Synthetic oligonucleotide
cagatgcttttgtgttataccgagt

SEQ ID NO: 736355 - DNA, 25 bp, Artificial sequence
  Synthetic oligonucleotide
cggacattaattccgtatgatcatg

SEQ ID NO: 736356 - DNA, 25 bp, Artificial sequence
  Synthetic oligonucleotide
gtgttttatcactaaaatttgaggt

SEQ ID NO: 736357 - DNA, 25 bp, Artificial sequence
  Synthetic oligonucleotide
ctgaagatgagagactgaaggttga

SEQ ID NO: 736358 - DNA, 25 bp, Artificial sequence
  Synthetic oligonucleotide
tctatgaaacatgtagcaggtacta

SEQ ID NO: 736359 - DNA, 25 bp, Artificial sequence
  Synthetic oligonucleotide
atgaaaaatcggcttttatggctga

SEQ ID NO: 736360 - DNA, 25 bp, Artificial sequence
  Synthetic oligonucleotide
ctccgaaagagagcgcttatctcat

SEQ ID NO: 736361 - DNA, 25 bp, Artificial sequence
  Synthetic oligonucleotide
acaagacacccagctttgagacagt

SEQ ID NO: 736362 - DNA, 25 bp, Artificial sequence
  Synthetic oligonucleotide
acaagacacccacctttgagacagt

SEQ ID NO: 736363 - DNA, 25 bp, Artificial sequence
  Synthetic oligonucleotide
aaaacataaaagagctgtttctttc

SEQ ID NO: 736364 - DNA, 25 bp, Artificial sequence
  Synthetic oligonucleotide
aaaacataaaagtgctgtttctttc

SEQ ID NO: 736365 - DNA, 25 bp, Artificial sequence
  Synthetic oligonucleotide
tggagcttcaaaatctcattgaaaa

SEQ ID NO: 736366 - DNA, 25 bp, Artificial sequence
  Synthetic oligonucleotide
tggagcttcaaattctcattgaaaa

SEQ ID NO: 736367 - DNA, 25 bp, Artificial sequence
  Synthetic oligonucleotide
aaaacgaaaaaatggatgtattcca

SEQ ID NO: 736368 - DNA, 25 bp, Artificial sequence
  Synthetic oligonucleotide
aaaacgaaaaaaaggatgtattcca

SEQ ID NO: 736369 - DNA, 25 bp, Artificial sequence
  Synthetic oligonucleotide
gtccactttatcgaatatgcaaggc

SEQ ID NO: 736370 - DNA, 25 bp, Artificial sequence
  Synthetic oligonucleotide
gtgttttatcacaaaaatttgaggt

SEQ ID NO: 736371 - DNA, 25 bp, Artificial sequence
  Synthetic oligonucleotide
aaaagcaatccaagctttgtttggg

SEQ ID NO: 736372 - DNA, 25 bp, Artificial sequence
  Synthetic oligonucleotide
ttgttaatgaatcgatagagacgat

SEQ ID NO: 736373 - DNA, 25 bp, Artificial sequence
  Synthetic oligonucleotide
ttgttaatgaatggatagagacgat

SEQ ID NO: 736374 - DNA, 25 bp, Artificial sequence
  Synthetic oligonucleotide
gtcaagtttgtgtcgaaaaacaggt

SEQ ID NO: 736375 - DNA, 25 bp, Artificial sequence
  Synthetic oligonucleotide
gtcaagtttgtgacgaaaaacaggt

SEQ ID NO: 736376 - DNA, 25 bp, Artificial sequence
  Synthetic oligonucleotide
gaaaagtatctcggcaagatgtgaa

SEQ ID NO: 736377 - DNA, 25 bp, Artificial sequence
  Synthetic oligonucleotide
gaaaagtatctccgcaagatgtgaa

SEQ ID NO: 736378 - DNA, 25 bp, Artificial sequence
  Synthetic oligonucleotide
cggattatctggcctttatttttgc

SEQ ID NO: 736379 - DNA, 25 bp, Artificial sequence
  Synthetic oligonucleotide
cggattatctgggctttatttttgc

SEQ ID NO: 736380 - DNA, 25 bp, Artificial sequence
  Synthetic oligonucleotide
cactgcaggattagcagcttgcagc

SEQ ID NO: 736381 - DNA, 25 bp, Artificial sequence
  Synthetic oligonucleotide
cactgcaggatttgcagcttgcagc

SEQ ID NO: 736382 - DNA, 25 bp, Artificial sequence
  Synthetic oligonucleotide
tgaagaagccgggattaaaatattg

SEQ ID NO: 736383 - DNA, 25 bp, Artificial sequence
  Synthetic oligonucleotide
tcacaaatggcagacttgaagattt

SEQ ID NO: 736384 - DNA, 25 bp, Artificial sequence
  Synthetic oligonucleotide
aaaagcaatccatgctttgtttggg

SEQ ID NO: 736385 - DNA, 25 bp, Artificial sequence
  Synthetic oligonucleotide
gtgatgaggaacctgcggatgccga

SEQ ID NO: 736386 - DNA, 25 bp, Artificial sequence
  Synthetic oligonucleotide
tattggtgaatcattgatgagacaa

SEQ ID NO: 736387 - DNA, 25 bp, Artificial sequence
  Synthetic oligonucleotide
tattggtgaatctttgatgagacaa

SEQ ID NO: 736388 - DNA, 25 bp, Artificial sequence
  Synthetic oligonucleotide
aacatttgtcaatgaacatggagca

SEQ ID NO: 736389 - DNA, 25 bp, Artificial sequence
  Synthetic oligonucleotide
aacatttgtcaaagaacatggagca

SEQ ID NO: 736390 - DNA, 25 bp, Artificial sequence
  Synthetic oligonucleotide
tgtcagcgaaaggggaatcggttct

SEQ ID NO: 736391 - DNA, 25 bp, Artificial sequence
  Synthetic oligonucleotide
tgtcagcgaaagcggaatcggttct

SEQ ID NO: 736392 - DNA, 25 bp, Artificial sequence
  Synthetic oligonucleotide
acaaatcgcatcacttgctccgaaa

SEQ ID NO: 736393 - DNA, 25 bp, Artificial sequence
  Synthetic oligonucleotide
acaaatcgcatctcttgctccgaaa

SEQ ID NO: 736394 - DNA, 25 bp, Artificial sequence
  Synthetic oligonucleotide
cctaaaaacgttagaaacatctgta

SEQ ID NO: 736395 - DNA, 25 bp, Artificial sequence
  Synthetic oligonucleotide
cctaaaaacgtttgaaacatctgta

SEQ ID NO: 736396 - DNA, 25 bp, Artificial sequence
  Synthetic oligonucleotide
attcacgcctgaaattctcggcata

SEQ ID NO: 736397 - DNA, 25 bp, Artificial sequence
  Synthetic oligonucleotide
tgaagaagccggcattaaaatattg

SEQ ID NO: 736398 - DNA, 25 bp, Artificial sequence
  Synthetic oligonucleotide
taggaaaacgttcttttatcgcagg

SEQ ID NO: 736399 - DNA, 25 bp, Artificial sequence
  Synthetic oligonucleotide
ccggaaacactcttgcagccgttag

SEQ ID NO: 736400 - DNA, 25 bp, Artificial sequence
  Synthetic oligonucleotide
ccggaaacactcatgcagccgttag

SEQ ID NO: 736401 - DNA, 25 bp, Artificial sequence
  Synthetic oligonucleotide
ataggcagataccgtgattttggcg

SEQ ID NO: 736402 - DNA, 25 bp, Artificial sequence
  Synthetic oligonucleotide
ataggcagatacggtgattttggcg

SEQ ID NO: 736403 - DNA, 25 bp, Artificial sequence
  Synthetic oligonucleotide
aaaggatgaaccgatatgtatccat

SEQ ID NO: 736404 - DNA, 25 bp, Artificial sequence
  Synthetic oligonucleotide
aaaggatgaacccatatgtatccat

SEQ ID NO: 736405 - DNA, 25 bp, Artificial sequence
  Synthetic oligonucleotide
gacaaaaagatcagaatctgatgag

SEQ ID NO: 736406 - DNA, 25 bp, Artificial sequence
  Synthetic oligonucleotide
gacaaaaagatctgaatctgatgag

SEQ ID NO: 736407 - DNA, 25 bp, Artificial sequence
  Synthetic oligonucleotide
caggaattgaccttgccagcggaat

SEQ ID NO: 736408 - DNA, 25 bp, Artificial sequence
  Synthetic oligonucleotide
caggaattgaccatgccagcggaat

SEQ ID NO: 736409 - DNA, 25 bp, Artificial sequence
  Synthetic oligonucleotide
cggacactatcagagacttaatgaa

SEQ ID NO: 736410 - DNA, 25 bp, Artificial sequence
  Synthetic oligonucleotide
ccgaagacttaaatctagacgtcat

SEQ ID NO: 736411 - DNA, 25 bp, Artificial sequence
  Synthetic oligonucleotide
taggaaaacgttgttttatcgcagg

SEQ ID NO: 736412 - DNA, 25 bp, Artificial sequence
  Synthetic oligonucleotide
ccgaagacttaattctagacgtcat

SEQ ID NO: 736413 - DNA, 25 bp, Artificial sequence
  Synthetic oligonucleotide
cttgggactgtgtgccggaatacca

SEQ ID NO: 736414 - DNA, 25 bp, Artificial sequence
  Synthetic oligonucleotide
cttgggactgtgagccggaatacca

SEQ ID NO: 736415 - DNA, 25 bp, Artificial sequence
  Synthetic oligonucleotide
tcaaaggggcaacagggggcactgg

SEQ ID NO: 736416 - DNA, 25 bp, Artificial sequence
  Synthetic oligonucleotide
tcaaaggggcaagagggggcactgg

SEQ ID NO: 736417 - DNA, 25 bp, Artificial sequence
  Synthetic oligonucleotide
aagatgatgtggtcggctttgtgat

SEQ ID NO: 736418 - DNA, 25 bp, Artificial sequence
  Synthetic oligonucleotide
aagatgatgtggacggctttgtgat

SEQ ID NO: 736419 - DNA, 25 bp, Artificial sequence
  Synthetic oligonucleotide
atcatgagaacagaactcaagagat

SEQ ID NO: 736420 - DNA, 25 bp, Artificial sequence
  Synthetic oligonucleotide
atcatgagaacacaactcaagagat

SEQ ID NO: 736421 - DNA, 25 bp, Artificial sequence
  Synthetic oligonucleotide
tgctgacagattgtgaaatatggaa

SEQ ID NO: 736422 - DNA, 25 bp, Artificial sequence
  Synthetic oligonucleotide
tgctgacagattctgaaatatggaa

SEQ ID NO: 736423 - DNA, 25 bp, Artificial sequence
  Synthetic oligonucleotide
gtgatgaggaacgtgcggatgccga

SEQ ID NO: 736424 - DNA, 25 bp, Artificial sequence
  Synthetic oligonucleotide
tcatgatgcaactacgctagaacaa

SEQ ID NO: 736425 - DNA, 25 bp, Artificial sequence
  Synthetic oligonucleotide
cggacactatcacagacttaatgaa

SEQ ID NO: 736426 - DNA, 25 bp, Artificial sequence
  Synthetic oligonucleotide
gccgggagtatagcgtttcacccga

SEQ ID NO: 736427 - DNA, 25 bp, Artificial sequence
  Synthetic oligonucleotide
attcacgcctgatattctcggcata

SEQ ID NO: 736428 - DNA, 25 bp, Artificial sequence
  Synthetic oligonucleotide
cattagagacgattacaagcggagg

SEQ ID NO: 736429 - DNA, 25 bp, Artificial sequence
  Synthetic oligonucleotide
cattagagacgaatacaagcggagg

SEQ ID NO: 736430 - DNA, 25 bp, Artificial sequence
  Synthetic oligonucleotide
ggatcaccgcctcactgaaggaagg

SEQ ID NO: 736431 - DNA, 25 bp, Artificial sequence
  Synthetic oligonucleotide
ggatcaccgcctgactgaaggaagg

SEQ ID NO: 736432 - DNA, 25 bp, Artificial sequence
  Synthetic oligonucleotide
cagcttttaatgcaggggctgcgat

SEQ ID NO: 736433 - DNA, 25 bp, Artificial sequence
  Synthetic oligonucleotide
cagcttttaatggaggggctgcgat

SEQ ID NO: 736434 - DNA, 25 bp, Artificial sequence
  Synthetic oligonucleotide
ttgaaaataaaaccagcagttccgc

SEQ ID NO: 736435 - DNA, 25 bp, Artificial sequence
  Synthetic oligonucleotide
ttgaaaataaaagcagcagttccgc

SEQ ID NO: 736436 - DNA, 25 bp, Artificial sequence
  Synthetic oligonucleotide
ctccgaaagagaccgcttatctcat

SEQ ID NO: 736437 - DNA, 25 bp, Artificial sequence
  Synthetic oligonucleotide
agcaatcctttacaggcgaagtcag

SEQ ID NO: 736438 - DNA, 25 bp, Artificial sequence
  Synthetic oligonucleotide
agcttgaacgactaaagcagaaaga

SEQ ID NO: 736439 - DNA, 25 bp, Artificial sequence
  Synthetic oligonucleotide
gtgagagcaatgaatttccaatcaa

SEQ ID NO: 736440 - DNA, 25 bp, Artificial sequence
  Synthetic oligonucleotide
atgcttgaaaacttcattaaacaaa

SEQ ID NO: 736441 - DNA, 25 bp, Artificial sequence
  Synthetic oligonucleotide
gccgggagtataccgtttcacccga

SEQ ID NO: 736442 - DNA, 25 bp, Artificial sequence
  Synthetic oligonucleotide
gcaccgaccgacctgattgaattaa

SEQ ID NO: 736443 - DNA, 25 bp, Artificial sequence
  Synthetic oligonucleotide
gcaccgaccgacgtgattgaattaa

SEQ ID NO: 736444 - DNA, 25 bp, Artificial sequence
  Synthetic oligonucleotide
tcaagccgtgaccgtttagatgagc

SEQ ID NO: 736445 - DNA, 25 bp, Artificial sequence
  Synthetic oligonucleotide
tcaagccgtgacggtttagatgagc

SEQ ID NO: 736446 - DNA, 25 bp, Artificial sequence
  Synthetic oligonucleotide
ctggagacgtttcagccgaagcacg

SEQ ID NO: 736447 - DNA, 25 bp, Artificial sequence
  Synthetic oligonucleotide
ctggagacgtttgagccgaagcacg

SEQ ID NO: 736448 - DNA, 25 bp, Artificial sequence
  Synthetic oligonucleotide
aaaaaatactgatttgtaatacgat

SEQ ID NO: 736449 - DNA, 25 bp, Artificial sequence
  Synthetic oligonucleotide
tattctgttgaaaaagctggactga

SEQ ID NO: 736450 - DNA, 25 bp, Artificial sequence
  Synthetic oligonucleotide
agcaatcctttagaggcgaagtcag

SEQ ID NO: 736451 - DNA, 25 bp, Artificial sequence
  Synthetic oligonucleotide
ggtttcagaacgctatttaatctgc

SEQ ID NO: 736452 - DNA, 25 bp, Artificial sequence
  Synthetic oligonucleotide
ggtttcagaacggtatttaatctgc

SEQ ID NO: 736453 - DNA, 25 bp, Artificial sequence
  Synthetic oligonucleotide
tcacaaatggcacacttgaagattt

SEQ ID NO: 736454 - DNA, 25 bp, Artificial sequence
  Synthetic oligonucleotide
aaacctgatgcgctttccgttttaa

SEQ ID NO: 736455 - DNA, 25 bp, Artificial sequence
  Synthetic oligonucleotide
tctatgaaacatctagcaggtacta

SEQ ID NO: 736456 - DNA, 25 bp, Artificial sequence
  Synthetic oligonucleotide
agcaggtgaaaacgagatggacgtg

SEQ ID NO: 736457 - DNA, 25 bp, Artificial sequence
  Synthetic oligonucleotide
agcaggtgaaaaggagatggacgtg

SEQ ID NO: 736458 - DNA, 25 bp, Artificial sequence
  Synthetic oligonucleotide
gcttgatccctttcaccttcatgaa

SEQ ID NO: 736459 - DNA, 25 bp, Artificial sequence
  Synthetic oligonucleotide
gcttgatcccttacaccttcatgaa

SEQ ID NO: 736460 - DNA, 25 bp, Artificial sequence
  Synthetic oligonucleotide
aatcggagcggaagccatattgtta

SEQ ID NO: 736461 - DNA, 25 bp, Artificial sequence
  Synthetic oligonucleotide
aatcggagcggatgccatattgtta

SEQ ID NO: 736462 - DNA, 25 bp, Artificial sequence
  Synthetic oligonucleotide
tattattgattcacttcaagtggag

SEQ ID NO: 736463 - DNA, 25 bp, Artificial sequence
  Synthetic oligonucleotide
tattattgattctcttcaagtggag

SEQ ID NO: 736464 - DNA, 25 bp, Artificial sequence
  Synthetic oligonucleotide
gcgcgctgtttccatacctgtactc

SEQ ID NO: 736465 - DNA, 25 bp, Artificial sequence
  Synthetic oligonucleotide
gcgcgctgtttcgatacctgtactc

SEQ ID NO: 736466 - DNA, 25 bp, Artificial sequence
  Synthetic oligonucleotide
agcttgaacgacaaaagcagaaaga

SEQ ID NO: 736467 - DNA, 25 bp, Artificial sequence
  Synthetic oligonucleotide
ttttcaaggggaaaacagctattta

SEQ ID NO: 736468 - DNA, 25 bp, Artificial sequence
  Synthetic oligonucleotide
tcatgatgcaacaacgctagaacaa

SEQ ID NO: 736469 - DNA, 25 bp, Artificial sequence
  Synthetic oligonucleotide
aaacctgatgcggtttccgttttaa

SEQ ID NO: 736470 - DNA, 25 bp, Artificial sequence
  Synthetic oligonucleotide
gtacctgtgcggattgcaaaagact

SEQ ID NO: 736471 - DNA, 25 bp, Artificial sequence
  Synthetic oligonucleotide
gtacctgtgcggtttgcaaaagact

SEQ ID NO: 736472 - DNA, 25 bp, Artificial sequence
  Synthetic oligonucleotide
gcgtcgccgtcaaaagggcttatta

SEQ ID NO: 736473 - DNA, 25 bp, Artificial sequence
  Synthetic oligonucleotide
gcgtcgccgtcataagggcttatta

SEQ ID NO: 736474 - DNA, 25 bp, Artificial sequence
  Synthetic oligonucleotide
aatcggtttatccggttgattgctg

SEQ ID NO: 736475 - DNA, 25 bp, Artificial sequence
  Synthetic oligonucleotide
aatcggtttatcgggttgattgctg

SEQ ID NO: 736476 - DNA, 25 bp, Artificial sequence
  Synthetic oligonucleotide
gaaaaacgttcaattaaagaggcgc

SEQ ID NO: 736477 - DNA, 25 bp, Artificial sequence
  Synthetic oligonucleotide
gaaaaacgttcatttaaagaggcgc

SEQ ID NO: 736478 - DNA, 25 bp, Artificial sequence
  Synthetic oligonucleotide
gtaaaaacactgctcttgccggaag

SEQ ID NO: 736479 - DNA, 25 bp, Artificial sequence
  Synthetic oligonucleotide
gtaaaaacactggtcttgccggaag

SEQ ID NO: 736480 - DNA, 25 bp, Artificial sequence
  Synthetic oligonucleotide
atgcttgaaaacatcattaaacaaa

SEQ ID NO: 736481 - DNA, 25 bp, Artificial sequence
  Synthetic oligonucleotide
ttttcaaggggataacagctattta

SEQ ID NO: 736482 - DNA, 25 bp, Artificial sequence
  Synthetic oligonucleotide
tattctgttgaataagctggactga

SEQ ID NO: 736483 - DNA, 25 bp, Artificial sequence
  Synthetic oligonucleotide
tctcatgccatcttctcattctcct

SEQ ID NO: 736484 - DNA, 25 bp, Artificial sequence
  Synthetic oligonucleotide
aaaaaatactgaattgtaatacgat

SEQ ID NO: 736485 - DNA, 25 bp, Artificial sequence
  Synthetic oligonucleotide
agaaatacacaagagtgtgtataaa

SEQ ID NO: 736486 - DNA, 25 bp, Artificial sequence
  Synthetic oligonucleotide
agaaatacacaacagtgtgtataaa

SEQ ID NO: 736487 - DNA, 25 bp, Artificial sequence
  Synthetic oligonucleotide
gagttgagttagtgaatagggtagc

SEQ ID NO: 736488 - DNA, 25 bp, Artificial sequence
  Synthetic oligonucleotide
ttagttgagctgtgacattatgttt

SEQ ID NO: 736489 - DNA, 25 bp, Artificial sequence
  Synthetic oligonucleotide
ttagttgagctgagacattatgttt

SEQ ID NO: 736490 - DNA, 25 bp, Artificial sequence
  Synthetic oligonucleotide
ttcttttgggtttatttgttatata

SEQ ID NO: 736491 - DNA, 25 bp, Artificial sequence
  Synthetic oligonucleotide
ttcttttgggttaatttgttatata

SEQ ID NO: 736492 - DNA, 25 bp, Artificial sequence
  Synthetic oligonucleotide
tctcatgccatcatctcattctcct

SEQ ID NO: 736493 - DNA, 25 bp, Artificial sequence
  Synthetic oligonucleotide
gagttgagttagagaatagggtagc

SEQ ID NO: 736494 - DNA, 25 bp, Artificial sequence
  Synthetic oligonucleotide
tagctgctgcttctgaagtatggaa

SEQ ID NO: 736495 - DNA, 25 bp, Artificial sequence
  Synthetic oligonucleotide
taaaaaagattgagccgaggttatc

SEQ ID NO: 736496 - DNA, 25 bp, Artificial sequence
  Synthetic oligonucleotide
taaaaaagattgtgccgaggttatc

SEQ ID NO: 736497 - DNA, 25 bp, Artificial sequence
  Synthetic oligonucleotide
tagtttaattgcactcggctcaatc

SEQ ID NO: 736498 - DNA, 25 bp, Artificial sequence
  Synthetic oligonucleotide
tagtttaattgctctcggctcaatc

SEQ ID NO: 736499 - DNA, 25 bp, Artificial sequence
  Synthetic oligonucleotide
gatgaattagatatagtaattcacg

SEQ ID NO: 736500 - DNA, 25 bp, Artificial sequence
  Synthetic oligonucleotide
gatgaattagatttagtaattcacg

SEQ ID NO: 736501 - DNA, 25 bp, Artificial sequence
  Synthetic oligonucleotide
aacttcccaaccttcgataaattag

SEQ ID NO: 736502 - DNA, 25 bp, Artificial sequence
  Synthetic oligonucleotide
aattatccgtgatgcttgcaaatgg

SEQ ID NO: 736503 - DNA, 25 bp, Artificial sequence
  Synthetic oligonucleotide
tagctgctgcttgtgaagtatggaa

SEQ ID NO: 736504 - DNA, 25 bp, Artificial sequence
  Synthetic oligonucleotide
ttttttgatagaaacatacttaaat

SEQ ID NO: 736505 - DNA, 25 bp, Artificial sequence
  Synthetic oligonucleotide
tctttcgtgtcagggcttgaaccaa

SEQ ID NO: 736506 - DNA, 25 bp, Artificial sequence
  Synthetic oligonucleotide
aacttcccaaccatcgataaattag

SEQ ID NO: 736507 - DNA, 25 bp, Artificial sequence
  Synthetic oligonucleotide
ttttttgatagatacatacttaaat

SEQ ID NO: 736508 - DNA, 25 bp, Artificial sequence
  Synthetic oligonucleotide
ctcttcaataaataaaagaagatta

SEQ ID NO: 736509 - DNA, 25 bp, Artificial sequence
  Synthetic oligonucleotide
ctcttcaataaaaaaaagaagatta

SEQ ID NO: 736510 - DNA, 25 bp, Artificial sequence
  Synthetic oligonucleotide
tgttattgtagtgttgtgtccacaa

SEQ ID NO: 736511 - DNA, 25 bp, Artificial sequence
  Synthetic oligonucleotide
tgttattgtagtcttgtgtccacaa

SEQ ID NO: 736512 - DNA, 25 bp, Artificial sequence
  Synthetic oligonucleotide
aattatccgtgaagcttgcaaatgg

SEQ ID NO: 736513 - DNA, 25 bp, Artificial sequence
  Synthetic oligonucleotide
gaaacatggattgttaattcttagg

SEQ ID NO: 736514 - DNA, 25 bp, Artificial sequence
  Synthetic oligonucleotide
gattctgtactacaattcggtggag

SEQ ID NO: 736515 - DNA, 25 bp, Artificial sequence
  Synthetic oligonucleotide
tctttcgtgtcacggcttgaaccaa

SEQ ID NO: 736516 - DNA, 25 bp, Artificial sequence
  Synthetic oligonucleotide
tcttctaccccatcctgcatgttgt

SEQ ID NO: 736517 - DNA, 25 bp, Artificial sequence
  Synthetic oligonucleotide
tcttctaccccaacctgcatgttgt

SEQ ID NO: 736518 - DNA, 25 bp, Artificial sequence
  Synthetic oligonucleotide
tttcattccgtattggaataaaaaa

SEQ ID NO: 736519 - DNA, 25 bp, Artificial sequence
  Synthetic oligonucleotide
tttcattccgtaatggaataaaaaa

SEQ ID NO: 736520 - DNA, 25 bp, Artificial sequence
  Synthetic oligonucleotide
gaaacatggattcttaattcttagg

SEQ ID NO: 736521 - DNA, 25 bp, Artificial sequence
  Synthetic oligonucleotide
tctttttcactctagattgggtctc

SEQ ID NO: 736522 - DNA, 25 bp, Artificial sequence
  Synthetic oligonucleotide
tactagtttgtctcattattgccga

SEQ ID NO: 736523 - DNA, 25 bp, Artificial sequence
  Synthetic oligonucleotide
acttcttcacatgcaccgtgcaatg

SEQ ID NO: 736524 - DNA, 25 bp, Artificial sequence
  Synthetic oligonucleotide
acttcttcacatccaccgtgcaatg

SEQ ID NO: 736525 - DNA, 25 bp, Artificial sequence
  Synthetic oligonucleotide
tagacagaagaatcatggtatgcac

SEQ ID NO: 736526 - DNA, 25 bp, Artificial sequence
  Synthetic oligonucleotide
tagacagaagaaacatggtatgcac

SEQ ID NO: 736527 - DNA, 25 bp, Artificial sequence
  Synthetic oligonucleotide
gctaaagctttaggtctatctggtg

SEQ ID NO: 736528 - DNA, 25 bp, Artificial sequence
  Synthetic oligonucleotide
gctaaagctttacgtctatctggtg

SEQ ID NO: 736529 - DNA, 25 bp, Artificial sequence
  Synthetic oligonucleotide
cacgcgggtacagtagtaggtaaac

SEQ ID NO: 736530 - DNA, 25 bp, Artificial sequence
  Synthetic oligonucleotide
cacgcgggtacactagtaggtaaac

SEQ ID NO: 736531 - DNA, 25 bp, Artificial sequence
  Synthetic oligonucleotide
gacagggagtcaactttgggctttg

SEQ ID NO: 736532 - DNA, 25 bp, Artificial sequence
  Synthetic oligonucleotide
gacagggagtcatctttgggctttg

SEQ ID NO: 736533 - DNA, 25 bp, Artificial sequence
  Synthetic oligonucleotide
cccttggggaaaagcaccgggtgcc

SEQ ID NO: 736534 - DNA, 25 bp, Artificial sequence
  Synthetic oligonucleotide
tgcgcgatgattttgttgaaaaaga

SEQ ID NO: 736535 - DNA, 25 bp, Artificial sequence
  Synthetic oligonucleotide
taatgagggacgtgatcttgcagtc

SEQ ID NO: 736536 - DNA, 25 bp, Artificial sequence
  Synthetic oligonucleotide
tctttttcactcaagattgggtctc

SEQ ID NO: 736537 - DNA, 25 bp, Artificial sequence
  Synthetic oligonucleotide
tggtgttctgcctgtggcttcaggg

SEQ ID NO: 736538 - DNA, 25 bp, Artificial sequence
  Synthetic oligonucleotide
tggtgttctgccagtggcttcaggg

SEQ ID NO: 736539 - DNA, 25 bp, Artificial sequence
  Synthetic oligonucleotide
tggcatatgcctcctttgaccgaga

SEQ ID NO: 736540 - DNA, 25 bp, Artificial sequence
  Synthetic oligonucleotide
tggcatatgcctgctttgaccgaga

SEQ ID NO: 736541 - DNA, 25 bp, Artificial sequence
  Synthetic oligonucleotide
tgcttactctgaatagaaaatgaac

SEQ ID NO: 736542 - DNA, 25 bp, Artificial sequence
  Synthetic oligonucleotide
gattctgtactagaattcggtggag

SEQ ID NO: 736543 - DNA, 25 bp, Artificial sequence
  Synthetic oligonucleotide
tagtatacgagattttactaaaaaa

SEQ ID NO: 736544 - DNA, 25 bp, Artificial sequence
  Synthetic oligonucleotide
cccttggggaaatgcaccgggtgcc

SEQ ID NO: 736545 - DNA, 25 bp, Artificial sequence
  Synthetic oligonucleotide
gagtagctctggtagcatgtgtaca

SEQ ID NO: 736546 - DNA, 25 bp, Artificial sequence
  Synthetic oligonucleotide
gagtagctctggaagcatgtgtaca

SEQ ID NO: 736547 - DNA, 25 bp, Artificial sequence
  Synthetic oligonucleotide
taatgagggacgagatcttgcagtc

SEQ ID NO: 736548 - DNA, 25 bp, Artificial sequence
  Synthetic oligonucleotide
tgcgcgatgattatgttgaaaaaga

SEQ ID NO: 736549 - DNA, 25 bp, Artificial sequence
  Synthetic oligonucleotide
taatgaaagttagatttataatttc

SEQ ID NO: 736550 - DNA, 25 bp, Artificial sequence
  Synthetic oligonucleotide
cttaataatcttagcaattgcatcg

SEQ ID NO: 736551 - DNA, 25 bp, Artificial sequence
  Synthetic oligonucleotide
gagattgacaatcattttagtgacc

SEQ ID NO: 736552 - DNA, 25 bp, Artificial sequence
  Synthetic oligonucleotide
tatagttattgtagttctagttatc

SEQ ID NO: 736553 - DNA, 25 bp, Artificial sequence
  Synthetic oligonucleotide
tatagttattgttgttctagttatc

SEQ ID NO: 736554 - DNA, 25 bp, Artificial sequence
  Synthetic oligonucleotide
tctaaaggtgactacgatctgcact

SEQ ID NO: 736555 - DNA, 25 bp, Artificial sequence
  Synthetic oligonucleotide
tctaaaggtgacaacgatctgcact

SEQ ID NO: 736556 - DNA, 25 bp, Artificial sequence
  Synthetic oligonucleotide
taaggatactaaatataattgtact

SEQ ID NO: 736557 - DNA, 25 bp, Artificial sequence
  Synthetic oligonucleotide
taaggatactaattataattgtact

SEQ ID NO: 736558 - DNA, 25 bp, Artificial sequence
  Synthetic oligonucleotide
tagttgcattgaatcttattttcgt

SEQ ID NO: 736559 - DNA, 25 bp, Artificial sequence
  Synthetic oligonucleotide
tagttgcattgattcttattttcgt

SEQ ID NO: 736560 - DNA, 25 bp, Artificial sequence
  Synthetic oligonucleotide
gataataactttataatcgatagta

SEQ ID NO: 736561 - DNA, 25 bp, Artificial sequence
  Synthetic oligonucleotide
gacaccttttttgttagggatagta

SEQ ID NO: 736562 - DNA, 25 bp, Artificial sequence
  Synthetic oligonucleotide
taatgaaagttacatttataatttc

SEQ ID NO: 736563 - DNA, 25 bp, Artificial sequence
  Synthetic oligonucleotide
gacaccttttttcttagggatagta

SEQ ID NO: 736564 - DNA, 25 bp, Artificial sequence
  Synthetic oligonucleotide
tgaaagcggaaagattcgtgaaagt

SEQ ID NO: 736565 - DNA, 25 bp, Artificial sequence
  Synthetic oligonucleotide
tgaaagcggaaacattcgtgaaagt

SEQ ID NO: 736566 - DNA, 25 bp, Artificial sequence
  Synthetic oligonucleotide
caagataagaacaaataggaatcgt

SEQ ID NO: 736567 - DNA, 25 bp, Artificial sequence
  Synthetic oligonucleotide
caagataagaactaataggaatcgt

SEQ ID NO: 736568 - DNA, 25 bp, Artificial sequence
  Synthetic oligonucleotide
gttctaaggattacgatataactca

SEQ ID NO: 736569 - DNA, 25 bp, Artificial sequence
  Synthetic oligonucleotide
gttctaaggatttcgatataactca

SEQ ID NO: 736570 - DNA, 25 bp, Artificial sequence
  Synthetic oligonucleotide
caatcaattgtgcattcaatgcgac

SEQ ID NO: 736571 - DNA, 25 bp, Artificial sequence
  Synthetic oligonucleotide
caatcaattgtggattcaatgcgac

SEQ ID NO: 736572 - DNA, 25 bp, Artificial sequence
  Synthetic oligonucleotide
tatggattaatgaataagaaagtca

SEQ ID NO: 736573 - DNA, 25 bp, Artificial sequence
  Synthetic oligonucleotide
tatggattaatgtataagaaagtca

SEQ ID NO: 736574 - DNA, 25 bp, Artificial sequence
  Synthetic oligonucleotide
tgtgaacaatgtggacattatttga

SEQ ID NO: 736575 - DNA, 25 bp, Artificial sequence
  Synthetic oligonucleotide
tgtgaacaatgtcgacattatttga

SEQ ID NO: 736576 - DNA, 25 bp, Artificial sequence
  Synthetic oligonucleotide
gataataactttttaatcgatagta

SEQ ID NO: 736577 - DNA, 25 bp, Artificial sequence
  Synthetic oligonucleotide
cagaagctctatcgaaaaatcgtgg

SEQ ID NO: 736578 - DNA, 25 bp, Artificial sequence
  Synthetic oligonucleotide
tcttatattcattagcgaagaacaa

SEQ ID NO: 736579 - DNA, 25 bp, Artificial sequence
  Synthetic oligonucleotide
tatgagaattttacacaatataaga

SEQ ID NO: 736580 - DNA, 25 bp, Artificial sequence
  Synthetic oligonucleotide
tcatttagaattaaaattgattcat

SEQ ID NO: 736581 - DNA, 25 bp, Artificial sequence
  Synthetic oligonucleotide
tcatttagaatttaaattgattcat

SEQ ID NO: 736582 - DNA, 25 bp, Artificial sequence
  Synthetic oligonucleotide
tactagtttgtcacattattgccga

SEQ ID NO: 736583 - DNA, 25 bp, Artificial sequence
  Synthetic oligonucleotide
cttaataatctttgcaattgcatcg

SEQ ID NO: 736584 - DNA, 25 bp, Artificial sequence
  Synthetic oligonucleotide
tcttatattcataagcgaagaacaa

SEQ ID NO: 736585 - DNA, 25 bp, Artificial sequence
  Synthetic oligonucleotide
tgcttactctgattagaaaatgaac

SEQ ID NO: 736586 - DNA, 25 bp, Artificial sequence
  Synthetic oligonucleotide
tgcatttttcaaatttttcattgaa

SEQ ID NO: 736587 - DNA, 25 bp, Artificial sequence
  Synthetic oligonucleotide
tgcatttttcaattttttcattgaa

SEQ ID NO: 736588 - DNA, 25 bp, Artificial sequence
  Synthetic oligonucleotide
tcatctattgttattgtattttcat

SEQ ID NO: 736589 - DNA, 25 bp, Artificial sequence
  Synthetic oligonucleotide
gagattgacaatgattttagtgacc

SEQ ID NO: 736590 - DNA, 25 bp, Artificial sequence
  Synthetic oligonucleotide
cagaagctctatggaaaaatcgtgg

SEQ ID NO: 736591 - DNA, 25 bp, Artificial sequence
  Synthetic oligonucleotide
tagtatacgagaatttactaaaaaa

SEQ ID NO: 736592 - DNA, 25 bp, Artificial sequence
  Synthetic oligonucleotide
tttctaagggagaattggaatacag

SEQ ID NO: 736593 - DNA, 25 bp, Artificial sequence
  Synthetic oligonucleotide
tttctaagggagtattggaatacag

SEQ ID NO: 736594 - DNA, 25 bp, Artificial sequence
  Synthetic oligonucleotide
gtaaagcaatggttagttttgctcc

SEQ ID NO: 736595 - DNA, 25 bp, Artificial sequence
  Synthetic oligonucleotide
gtaaagcaatggatagttttgctcc

SEQ ID NO: 736596 - DNA, 25 bp, Artificial sequence
  Synthetic oligonucleotide
gactactataagacaagaccgtttt

SEQ ID NO: 736597 - DNA, 25 bp, Artificial sequence
  Synthetic oligonucleotide
gactactataagtcaagaccgtttt

SEQ ID NO: 736598 - DNA, 25 bp, Artificial sequence
  Synthetic oligonucleotide
aaaacttttatgcttgggatgagcg

SEQ ID NO: 736599 - DNA, 25 bp, Artificial sequence
  Synthetic oligonucleotide
aaaacttttatggttgggatgagcg

SEQ ID NO: 736600 - DNA, 25 bp, Artificial sequence
  Synthetic oligonucleotide
tctagttattccaataatgttgatc

SEQ ID NO: 736601 - DNA, 25 bp, Artificial sequence
  Synthetic oligonucleotide
tctagttattcctataatgttgatc

SEQ ID NO: 736602 - DNA, 25 bp, Artificial sequence
  Synthetic oligonucleotide
gctccaaggacaatcgcaatttcat

SEQ ID NO: 736603 - DNA, 25 bp, Artificial sequence
  Synthetic oligonucleotide
gctccaaggacattcgcaatttcat

SEQ ID NO: 736604 - DNA, 25 bp, Artificial sequence
  Synthetic oligonucleotide
tcatctattgtttttgtattttcat

SEQ ID NO: 736605 - DNA, 25 bp, Artificial sequence
  Synthetic oligonucleotide
gcaagcctttgtattatctagcgaa

SEQ ID NO: 736606 - DNA, 25 bp, Artificial sequence
  Synthetic oligonucleotide
gaaaaagaagtaataggttgcgcta

SEQ ID NO: 736607 - DNA, 25 bp, Artificial sequence
  Synthetic oligonucleotide
ttgttacgaattatttcgaatacag

SEQ ID NO: 736608 - DNA, 25 bp, Artificial sequence
  Synthetic oligonucleotide
cgatagcaaatttatcggttaattc

SEQ ID NO: 736609 - DNA, 25 bp, Artificial sequence
  Synthetic oligonucleotide
cgatagcaaattaatcggttaattc

SEQ ID NO: 736610 - DNA, 25 bp, Artificial sequence
  Synthetic oligonucleotide
gagtaagcactccatttcgttggtc

SEQ ID NO: 736611 - DNA, 25 bp, Artificial sequence
  Synthetic oligonucleotide
gagtaagcactcgatttcgttggtc

SEQ ID NO: 736612 - DNA, 25 bp, Artificial sequence
  Synthetic oligonucleotide
aagcggatgtggaattcaatttttt

SEQ ID NO: 736613 - DNA, 25 bp, Artificial sequence
  Synthetic oligonucleotide
aagcggatgtggtattcaatttttt

SEQ ID NO: 736614 - DNA, 25 bp, Artificial sequence
  Synthetic oligonucleotide
gaaggaatagtctttttcaagctca

SEQ ID NO: 736615 - DNA, 25 bp, Artificial sequence
  Synthetic oligonucleotide
gaaggaatagtcattttcaagctca

SEQ ID NO: 736616 - DNA, 25 bp, Artificial sequence
  Synthetic oligonucleotide
gaaagtcttttaattttttatcata

SEQ ID NO: 736617 - DNA, 25 bp, Artificial sequence
  Synthetic oligonucleotide
tagtaggatttgatctcataataaa

SEQ ID NO: 736618 - DNA, 25 bp, Artificial sequence
  Synthetic oligonucleotide
gcaagcctttgttttatctagcgaa

SEQ ID NO: 736619 - DNA, 25 bp, Artificial sequence
  Synthetic oligonucleotide
tccaatttttccgccacgacgataa

SEQ ID NO: 736620 - DNA, 25 bp, Artificial sequence
  Synthetic oligonucleotide
cggaactttagtaatgattcattat

SEQ ID NO: 736621 - DNA, 25 bp, Artificial sequence
  Synthetic oligonucleotide
cggaactttagttatgattcattat

SEQ ID NO: 736622 - DNA, 25 bp, Artificial sequence
  Synthetic oligonucleotide
tttttttcgtatattcattttagca

SEQ ID NO: 736623 - DNA, 25 bp, Artificial sequence
  Synthetic oligonucleotide
tttttttcgtattttcattttagca

SEQ ID NO: 736624 - DNA, 25 bp, Artificial sequence
  Synthetic oligonucleotide
gcgtcccatttattcatccctttag

SEQ ID NO: 736625 - DNA, 25 bp, Artificial sequence
  Synthetic oligonucleotide
gcgtcccatttaatcatccctttag

SEQ ID NO: 736626 - DNA, 25 bp, Artificial sequence
  Synthetic oligonucleotide
ttcattttcatgcatgaattccgca

SEQ ID NO: 736627 - DNA, 25 bp, Artificial sequence
  Synthetic oligonucleotide
ttcattttcatggatgaattccgca

SEQ ID NO: 736628 - DNA, 25 bp, Artificial sequence
  Synthetic oligonucleotide
tatctaggattttcatatacaacag

SEQ ID NO: 736629 - DNA, 25 bp, Artificial sequence
  Synthetic oligonucleotide
tatctaggatttacatatacaacag

SEQ ID NO: 736630 - DNA, 25 bp, Artificial sequence
  Synthetic oligonucleotide
ggatttataaaatgtcaaagattca

SEQ ID NO: 736631 - DNA, 25 bp, Artificial sequence
  Synthetic oligonucleotide
ggatttataaaaagtcaaagattca

SEQ ID NO: 736632 - DNA, 25 bp, Artificial sequence
  Synthetic oligonucleotide
gaaagtcttttatttttttatcata

SEQ ID NO: 736633 - DNA, 25 bp, Artificial sequence
  Synthetic oligonucleotide
gaggatttcccatatcaaccacgtc

SEQ ID NO: 736634 - DNA, 25 bp, Artificial sequence
  Synthetic oligonucleotide
tatgagaatttttcacaatataaga

SEQ ID NO: 736635 - DNA, 25 bp, Artificial sequence
  Synthetic oligonucleotide
cgtaatgcatgactacttaacaggg

SEQ ID NO: 736636 - DNA, 25 bp, Artificial sequence
  Synthetic oligonucleotide
tccaatttttcccccacgacgataa

SEQ ID NO: 736637 - DNA, 25 bp, Artificial sequence
  Synthetic oligonucleotide
gatctactacttaaattcctgtttc

SEQ ID NO: 736638 - DNA, 25 bp, Artificial sequence
  Synthetic oligonucleotide
gatctactactttaattcctgtttc

SEQ ID NO: 736639 - DNA, 25 bp, Artificial sequence
  Synthetic oligonucleotide
gtatctaattctttaaaagcaggcg

SEQ ID NO: 736640 - DNA, 25 bp, Artificial sequence
  Synthetic oligonucleotide
gtatctaattctataaaagcaggcg

SEQ ID NO: 736641 - DNA, 25 bp, Artificial sequence
  Synthetic oligonucleotide
taggagatgttgtgcgagtatcgac

SEQ ID NO: 736642 - DNA, 25 bp, Artificial sequence
  Synthetic oligonucleotide
taggagatgttgagcgagtatcgac

SEQ ID NO: 736643 - DNA, 25 bp, Artificial sequence
  Synthetic oligonucleotide
tatcaacgggttgcccaagcacgtt

SEQ ID NO: 736644 - DNA, 25 bp, Artificial sequence
  Synthetic oligonucleotide
tatcaacgggttccccaagcacgtt

SEQ ID NO: 736645 - DNA, 25 bp, Artificial sequence
  Synthetic oligonucleotide
ttgttacgaattttttcgaatacag

SEQ ID NO: 736646 - DNA, 25 bp, Artificial sequence
  Synthetic oligonucleotide
cctagagtcgctccgccgactggaa

SEQ ID NO: 736647 - DNA, 25 bp, Artificial sequence
  Synthetic oligonucleotide
tagtaggatttgttctcataataaa

SEQ ID NO: 736648 - DNA, 25 bp, Artificial sequence
  Synthetic oligonucleotide
gaggatttcccaaatcaaccacgtc

SEQ ID NO: 736649 - DNA, 25 bp, Artificial sequence
  Synthetic oligonucleotide
ttaaaccctctgacgcactcatagc

SEQ ID NO: 736650 - DNA, 25 bp, Artificial sequence
  Synthetic oligonucleotide
ttaaaccctctgtcgcactcatagc

SEQ ID NO: 736651 - DNA, 25 bp, Artificial sequence
  Synthetic oligonucleotide
gattatttcctattaattgctgtac

SEQ ID NO: 736652 - DNA, 25 bp, Artificial sequence
  Synthetic oligonucleotide
gattatttcctaataattgctgtac

SEQ ID NO: 736653 - DNA, 25 bp, Artificial sequence
  Synthetic oligonucleotide
taatttcttgacgaagagtatctcg

SEQ ID NO: 736654 - DNA, 25 bp, Artificial sequence
  Synthetic oligonucleotide
taatttcttgaccaagagtatctcg

SEQ ID NO: 736655 - DNA, 25 bp, Artificial sequence
  Synthetic oligonucleotide
caccagagcattctaaatattaggc

SEQ ID NO: 736656 - DNA, 25 bp, Artificial sequence
  Synthetic oligonucleotide
caccagagcattgtaaatattaggc

SEQ ID NO: 736657 - DNA, 25 bp, Artificial sequence
  Synthetic oligonucleotide
gggaaggctacaaccagtaccggac

SEQ ID NO: 736658 - DNA, 25 bp, Artificial sequence
  Synthetic oligonucleotide
gggaaggctacatccagtaccggac

SEQ ID NO: 736659 - DNA, 25 bp, Artificial sequence
  Synthetic oligonucleotide
tttttttcacgtatcgaaacctctg

SEQ ID NO: 736660 - DNA, 25 bp, Artificial sequence
  Synthetic oligonucleotide
cctagagtcgctgcgccgactggaa

SEQ ID NO: 736661 - DNA, 25 bp, Artificial sequence
  Synthetic oligonucleotide
tgtgaactcccaaccatttatgcgt

SEQ ID NO: 736662 - DNA, 25 bp, Artificial sequence
  Synthetic oligonucleotide
tttgaagaaggtacggttactaaca

SEQ ID NO: 736663 - DNA, 25 bp, Artificial sequence
  Synthetic oligonucleotide
tttgaagaaggttcggttactaaca

SEQ ID NO: 736664 - DNA, 25 bp, Artificial sequence
  Synthetic oligonucleotide
gggtaatgtatttgggttcaaagcc

SEQ ID NO: 736665 - DNA, 25 bp, Artificial sequence
  Synthetic oligonucleotide
gggtaatgtattagggttcaaagcc

SEQ ID NO: 736666 - DNA, 25 bp, Artificial sequence
  Synthetic oligonucleotide
tacgtctagaggatctgcgaatccc

SEQ ID NO: 736667 - DNA, 25 bp, Artificial sequence
  Synthetic oligonucleotide
tacgtctagaggttctgcgaatccc

SEQ ID NO: 736668 - DNA, 25 bp, Artificial sequence
  Synthetic oligonucleotide
aaactttccaaggaccacctcatgg

SEQ ID NO: 736669 - DNA, 25 bp, Artificial sequence
  Synthetic oligonucleotide
aaactttccaagcaccacctcatgg

SEQ ID NO: 736670 - DNA, 25 bp, Artificial sequence
  Synthetic oligonucleotide
gataaattgaactagtatggacgtc

SEQ ID NO: 736671 - DNA, 25 bp, Artificial sequence
  Synthetic oligonucleotide
gataaattgaacaagtatggacgtc

SEQ ID NO: 736672 - DNA, 25 bp, Artificial sequence
  Synthetic oligonucleotide
gatgtactattaaaccaaaattggg

SEQ ID NO: 736673 - DNA, 25 bp, Artificial sequence
  Synthetic oligonucleotide
cgcgaaaaactaaggtagagcagtt

SEQ ID NO: 736674 - DNA, 25 bp, Artificial sequence
  Synthetic oligonucleotide
gaaactcaattttttgcgtatgtag

SEQ ID NO: 736675 - DNA, 25 bp, Artificial sequence
  Synthetic oligonucleotide
tctacgtggtggacttgattttacc

SEQ ID NO: 736676 - DNA, 25 bp, Artificial sequence
  Synthetic oligonucleotide
gatgtactattataccaaaattggg

SEQ ID NO: 736677 - DNA, 25 bp, Artificial sequence
  Synthetic oligonucleotide
tgtgaactcccatccatttatgcgt

SEQ ID NO: 736678 - DNA, 25 bp, Artificial sequence
  Synthetic oligonucleotide
cgtttcttattttgtgccgaagcta

SEQ ID NO: 736679 - DNA, 25 bp, Artificial sequence
  Synthetic oligonucleotide
cgtttcttatttagtgccgaagcta

SEQ ID NO: 736680 - DNA, 25 bp, Artificial sequence
  Synthetic oligonucleotide
caggctgaaacaggtgaaatcaaag

SEQ ID NO: 736681 - DNA, 25 bp, Artificial sequence
  Synthetic oligonucleotide
caggctgaaacacgtgaaatcaaag

SEQ ID NO: 736682 - DNA, 25 bp, Artificial sequence
  Synthetic oligonucleotide
tgctactgcgggaacatgcgaagaa

SEQ ID NO: 736683 - DNA, 25 bp, Artificial sequence
  Synthetic oligonucleotide
tgctactgcgggtacatgcgaagaa

SEQ ID NO: 736684 - DNA, 25 bp, Artificial sequence
  Synthetic oligonucleotide
agctgtatttgcgagagaattggga

SEQ ID NO: 736685 - DNA, 25 bp, Artificial sequence
  Synthetic oligonucleotide
gaaaaagaagtattaggttgcgcta

SEQ ID NO: 736686 - DNA, 25 bp, Artificial sequence
  Synthetic oligonucleotide
tttttttcacgtttcgaaacctctg

SEQ ID NO: 736687 - DNA, 25 bp, Artificial sequence
  Synthetic oligonucleotide
agctgtatttgccagagaattggga

SEQ ID NO: 736688 - DNA, 25 bp, Artificial sequence
  Synthetic oligonucleotide
cgtaatgcatgagtacttaacaggg

SEQ ID NO: 736689 - DNA, 25 bp, Artificial sequence
  Synthetic oligonucleotide
tctacgtggtggtcttgattttacc

SEQ ID NO: 736690 - DNA, 25 bp, Artificial sequence
  Synthetic oligonucleotide
tattgcaagaattctaaattcatga

SEQ ID NO: 736691 - DNA, 25 bp, Artificial sequence
  Synthetic oligonucleotide
tacaataatgatgtatttggcgaat

SEQ ID NO: 736692 - DNA, 25 bp, Artificial sequence
  Synthetic oligonucleotide
cgcgaaaaactatggtagagcagtt

SEQ ID NO: 736693 - DNA, 25 bp, Artificial sequence
  Synthetic oligonucleotide
gaaactcaatttattgcgtatgtag

SEQ ID NO: 736694 - DNA, 25 bp, Artificial sequence
  Synthetic oligonucleotide
catggtctaatatagaataattctg

SEQ ID NO: 736695 - DNA, 25 bp, Artificial sequence
  Synthetic oligonucleotide
catggtctaataaagaataattctg

SEQ ID NO: 736696 - DNA, 25 bp, Artificial sequence
  Synthetic oligonucleotide
tgtgaaagattcgtgtgaaaaaggt

SEQ ID NO: 736697 - DNA, 25 bp, Artificial sequence
  Synthetic oligonucleotide
tgtgaaagattcctgtgaaaaaggt

SEQ ID NO: 736698 - DNA, 25 bp, Artificial sequence
  Synthetic oligonucleotide
attcctaatttatgtcgagtagacc

SEQ ID NO: 736699 - DNA, 25 bp, Artificial sequence
  Synthetic oligonucleotide
tattgcaagaatactaaattcatga

SEQ ID NO: 736700 - DNA, 25 bp, Artificial sequence
  Synthetic oligonucleotide
tacaataatgatctatttggcgaat

SEQ ID NO: 736701 - DNA, 25 bp, Artificial sequence
  Synthetic oligonucleotide
ggacttatgtcagcacaaacagaga

SEQ ID NO: 736702 - DNA, 25 bp, Artificial sequence
  Synthetic oligonucleotide
ggacttatgtcaccacaaacagaga

SEQ ID NO: 736703 - DNA, 25 bp, Artificial sequence
  Synthetic oligonucleotide
tgttgggttcaaagctggtgttaaa

SEQ ID NO: 736704 - DNA, 25 bp, Artificial sequence
  Synthetic oligonucleotide
tgttgggttcaatgctggtgttaaa

SEQ ID NO: 736705 - DNA, 25 bp, Artificial sequence
  Synthetic oligonucleotide
gaccgatgggcttaccagccttgat

SEQ ID NO: 736706 - DNA, 25 bp, Artificial sequence
  Synthetic oligonucleotide
gacgatgctacctcatcgagcccgt

SEQ ID NO: 736707 - DNA, 25 bp, Artificial sequence
  Synthetic oligonucleotide
attcctaatttaagtcgagtagacc

SEQ ID NO: 736708 - DNA, 25 bp, Artificial sequence
  Synthetic oligonucleotide
gacgatgctaccacatcgagcccgt

SEQ ID NO: 736709 - DNA, 25 bp, Artificial sequence
  Synthetic oligonucleotide
gaccgatgggctaaccagccttgat

SEQ ID NO: 736710 - DNA, 25 bp, Artificial sequence
  Synthetic oligonucleotide
gctgaatcttctactggtacatgga

SEQ ID NO: 736711 - DNA, 25 bp, Artificial sequence
  Synthetic oligonucleotide
gctgaatcttcttctggtacatgga

SEQ ID NO: 736712 - DNA, 25 bp, Artificial sequence
  Synthetic oligonucleotide
tggagttccaccagaagaagcaggg

SEQ ID NO: 736713 - DNA, 25 bp, Artificial sequence
  Synthetic oligonucleotide
tggagttccacctgaagaagcaggg

SEQ ID NO: 736714 - DNA, 25 bp, Artificial sequence
  Synthetic oligonucleotide
gatatcttggcaccattccgagtaa

SEQ ID NO: 736715 - DNA, 25 bp, Artificial sequence
  Synthetic oligonucleotide
gatatcttggcagcattccgagtaa

SEQ ID NO: 736716 - DNA, 25 bp, Artificial sequence
  Synthetic oligonucleotide
gacttactatacacctgaatatgaa

SEQ ID NO: 736717 - DNA, 25 bp, Artificial sequence
  Synthetic oligonucleotide
gacttactatactcctgaatatgaa

SEQ ID NO: 736718 - DNA, 25 bp, Artificial sequence
  Synthetic oligonucleotide
gaaagaggctggttaactcaaggga

SEQ ID NO: 736719 - DNA, 25 bp, Artificial sequence
  Synthetic oligonucleotide
cagccaggctgcattgggagacgca

SEQ ID NO: 736720 - DNA, 25 bp, Artificial sequence
  Synthetic oligonucleotide
cagccaggctgctttgggagacgca

SEQ ID NO: 736721 - DNA, 25 bp, Artificial sequence
  Synthetic oligonucleotide
gaatgtcaagagtgtccaacttgcc

SEQ ID NO: 736722 - DNA, 25 bp, Artificial sequence
  Synthetic oligonucleotide
gaatgtcaagagagtccaacttgcc

SEQ ID NO: 736723 - DNA, 25 bp, Artificial sequence
  Synthetic oligonucleotide
tatggaatacggaaacatgcttgtg

SEQ ID NO: 736724 - DNA, 25 bp, Artificial sequence
  Synthetic oligonucleotide
tatggaatacggtaacatgcttgtg

SEQ ID NO: 736725 - DNA, 25 bp, Artificial sequence
  Synthetic oligonucleotide
cgtgttcgagcatcccgagatgact

SEQ ID NO: 736726 - DNA, 25 bp, Artificial sequence
  Synthetic oligonucleotide
gaagttcgttgagagccttggagtt

SEQ ID NO: 736727 - DNA, 25 bp, Artificial sequence
  Synthetic oligonucleotide
cgtgttcgagcaacccgagatgact

SEQ ID NO: 736728 - DNA, 25 bp, Artificial sequence
  Synthetic oligonucleotide
catcggccgcggaactttctacggt

SEQ ID NO: 736729 - DNA, 25 bp, Artificial sequence
  Synthetic oligonucleotide
gaaagaggctggataactcaaggga

SEQ ID NO: 736730 - DNA, 25 bp, Artificial sequence
  Synthetic oligonucleotide
tgctttgagggccagagtgtacgat

SEQ ID NO: 736731 - DNA, 25 bp, Artificial sequence
  Synthetic oligonucleotide
tgctttgagggcgagagtgtacgat

SEQ ID NO: 736732 - DNA, 25 bp, Artificial sequence
  Synthetic oligonucleotide
gaagttcgttgacagccttggagtt

SEQ ID NO: 736733 - DNA, 25 bp, Artificial sequence
  Synthetic oligonucleotide
agttaaacttacttgacttgcagga

SEQ ID NO: 736734 - DNA, 25 bp, Artificial sequence
  Synthetic oligonucleotide
ggaacctgtgtctacaacttttgag

SEQ ID NO: 736735 - DNA, 25 bp, Artificial sequence
  Synthetic oligonucleotide
ttgagagtggaaacgcaggagaacc

SEQ ID NO: 736736 - DNA, 25 bp, Artificial sequence
  Synthetic oligonucleotide
tctgatatgtgtatttggtgtggac

SEQ ID NO: 736737 - DNA, 25 bp, Artificial sequence
  Synthetic oligonucleotide
ggctgaaaacttagatccaacggct

SEQ ID NO: 736738 - DNA, 25 bp, Artificial sequence
  Synthetic oligonucleotide
taaacctgccagttcctgaagggtg

SEQ ID NO: 736739 - DNA, 25 bp, Artificial sequence
  Synthetic oligonucleotide
ggctgaaaactttgatccaacggct

SEQ ID NO: 736740 - DNA, 25 bp, Artificial sequence
  Synthetic oligonucleotide
taaacctgccagatcctgaagggtg

SEQ ID NO: 736741 - DNA, 25 bp, Artificial sequence
  Synthetic oligonucleotide
catcggccgcggtactttctacggt

SEQ ID NO: 736742 - DNA, 25 bp, Artificial sequence
  Synthetic oligonucleotide
gcttattaatttcctgttttactcc

SEQ ID NO: 736743 - DNA, 25 bp, Artificial sequence
  Synthetic oligonucleotide
agttaaacttacatgacttgcagga

SEQ ID NO: 736744 - DNA, 25 bp, Artificial sequence
  Synthetic oligonucleotide
taaaagagaaagtgaagaaaatgga

SEQ ID NO: 736745 - DNA, 25 bp, Artificial sequence
  Synthetic oligonucleotide
taaaagagaaagagaagaaaatgga

SEQ ID NO: 736746 - DNA, 25 bp, Artificial sequence
  Synthetic oligonucleotide
tgttttttggtttagttggccactg

SEQ ID NO: 736747 - DNA, 25 bp, Artificial sequence
  Synthetic oligonucleotide
tgttttttggttaagttggccactg

SEQ ID NO: 736748 - DNA, 25 bp, Artificial sequence
  Synthetic oligonucleotide
ggaacctgtgtcaacaacttttgag

SEQ ID NO: 736749 - DNA, 25 bp, Artificial sequence
  Synthetic oligonucleotide
caagaagggaaagatgtgttgtctc

SEQ ID NO: 736750 - DNA, 25 bp, Artificial sequence
  Synthetic oligonucleotide
tatccgtcagagctaccgtgaggca

SEQ ID NO: 736751 - DNA, 25 bp, Artificial sequence
  Synthetic oligonucleotide
catgaacattgctgataacccaacc

SEQ ID NO: 736752 - DNA, 25 bp, Artificial sequence
  Synthetic oligonucleotide
cagtacactgtctacaaccagatgg

SEQ ID NO: 736753 - DNA, 25 bp, Artificial sequence
  Synthetic oligonucleotide
cagtacactgtcaacaaccagatgg

SEQ ID NO: 736754 - DNA, 25 bp, Artificial sequence
  Synthetic oligonucleotide
atcttgacgctgctgcgggtcgtat

SEQ ID NO: 736755 - DNA, 25 bp, Artificial sequence
  Synthetic oligonucleotide
cccaggaatgtacaacaaggaagag

SEQ ID NO: 736756 - DNA, 25 bp, Artificial sequence
  Synthetic oligonucleotide
caagaagggaaacatgtgttgtctc

SEQ ID NO: 736757 - DNA, 25 bp, Artificial sequence
  Synthetic oligonucleotide
cccaggaatgtagaacaaggaagag

SEQ ID NO: 736758 - DNA, 25 bp, Artificial sequence
  Synthetic oligonucleotide
tatccgtcagaggtaccgtgaggca

SEQ ID NO: 736759 - DNA, 25 bp, Artificial sequence
  Synthetic oligonucleotide
ttgagagtggaatcgcaggagaacc

SEQ ID NO: 736760 - DNA, 25 bp, Artificial sequence
  Synthetic oligonucleotide
ttttgcagcccaatcatgatgagtg

SEQ ID NO: 736761 - DNA, 25 bp, Artificial sequence
  Synthetic oligonucleotide
gcttattaatttgctgttttactcc

SEQ ID NO: 736762 - DNA, 25 bp, Artificial sequence
  Synthetic oligonucleotide
ttttgcagcccattcatgatgagtg

SEQ ID NO: 736763 - DNA, 25 bp, Artificial sequence
  Synthetic oligonucleotide
gctctctttcgacaagaatctaaaa

SEQ ID NO: 736764 - DNA, 25 bp, Artificial sequence
  Synthetic oligonucleotide
atcttgacgctggtgcgggtcgtat

SEQ ID NO: 736765 - DNA, 25 bp, Artificial sequence
  Synthetic oligonucleotide
tatcggtgtctggaagggtatcttc

SEQ ID NO: 736766 - DNA, 25 bp, Artificial sequence
  Synthetic oligonucleotide
ccctgaaaatgtactatataggacc

SEQ ID NO: 736767 - DNA, 25 bp, Artificial sequence
  Synthetic oligonucleotide
ccctgaaaatgttctatataggacc

SEQ ID NO: 736768 - DNA, 25 bp, Artificial sequence
  Synthetic oligonucleotide
gttccctggtcattctatcggtaag

SEQ ID NO: 736769 - DNA, 25 bp, Artificial sequence
  Synthetic oligonucleotide
gttccctggtcaatctatcggtaag

SEQ ID NO: 736770 - DNA, 25 bp, Artificial sequence
  Synthetic oligonucleotide
gatcaaggacgaagacattgtcaca

SEQ ID NO: 736771 - DNA, 25 bp, Artificial sequence
  Synthetic oligonucleotide
catgaacattgcagataacccaacc

SEQ ID NO: 736772 - DNA, 25 bp, Artificial sequence
  Synthetic oligonucleotide
tatcggtgtctgcaagggtatcttc

SEQ ID NO: 736773 - DNA, 25 bp, Artificial sequence
  Synthetic oligonucleotide
tctgatatgtgtttttggtgtggac

SEQ ID NO: 736774 - DNA, 25 bp, Artificial sequence
  Synthetic oligonucleotide
ggagaagttctactgggccccgacc

SEQ ID NO: 736775 - DNA, 25 bp, Artificial sequence
  Synthetic oligonucleotide
ggagaagttctagtgggccccgacc

SEQ ID NO: 736776 - DNA, 25 bp, Artificial sequence
  Synthetic oligonucleotide
tatacgctcctctcatccgtgatgg

SEQ ID NO: 736777 - DNA, 25 bp, Artificial sequence
  Synthetic oligonucleotide
tatacgctcctcacatccgtgatgg

SEQ ID NO: 736778 - DNA, 25 bp, Artificial sequence
  Synthetic oligonucleotide
ccccatcatttgcactggtaacgat

SEQ ID NO: 736779 - DNA, 25 bp, Artificial sequence
  Synthetic oligonucleotide
ccccatcatttggactggtaacgat

SEQ ID NO: 736780 - DNA, 25 bp, Artificial sequence
  Synthetic oligonucleotide
gatcaaggacgatgacattgtcaca

SEQ ID NO: 736781 - DNA, 25 bp, Artificial sequence
  Synthetic oligonucleotide
actgaaaattcttacggtcgacctc

SEQ ID NO: 736782 - DNA, 25 bp, Artificial sequence
  Synthetic oligonucleotide
tcaggttttagaagtaacgaccttg

SEQ ID NO: 736783 - DNA, 25 bp, Artificial sequence
  Synthetic oligonucleotide
gaaatcctctgtagagactcaagac

SEQ ID NO: 736784 - DNA, 25 bp, Artificial sequence
  Synthetic oligonucleotide
gaaatcctctgttgagactcaagac

SEQ ID NO: 736785 - DNA, 25 bp, Artificial sequence
  Synthetic oligonucleotide
cctgtcttctataggtcttgaacga

SEQ ID NO: 736786 - DNA, 25 bp, Artificial sequence
  Synthetic oligonucleotide
cctgtcttctattggtcttgaacga

SEQ ID NO: 736787 - DNA, 25 bp, Artificial sequence
  Synthetic oligonucleotide
tcccggaaagttacgaagctcccat

SEQ ID NO: 736788 - DNA, 25 bp, Artificial sequence
  Synthetic oligonucleotide
ggcggaactctgatgacacaatcat

SEQ ID NO: 736789 - DNA, 25 bp, Artificial sequence
  Synthetic oligonucleotide
taaacaaagaccaaacaaaacaagc

SEQ ID NO: 736790 - DNA, 25 bp, Artificial sequence
  Synthetic oligonucleotide
actgaaaattctaacggtcgacctc

SEQ ID NO: 736791 - DNA, 25 bp, Artificial sequence
  Synthetic oligonucleotide
gctgtttagtacgtaaccgaagcaa

SEQ ID NO: 736792 - DNA, 25 bp, Artificial sequence
  Synthetic oligonucleotide
gctgtttagtacctaaccgaagcaa

SEQ ID NO: 736793 - DNA, 25 bp, Artificial sequence
  Synthetic oligonucleotide
gaggctaactatcgcagggcttttg

SEQ ID NO: 736794 - DNA, 25 bp, Artificial sequence
  Synthetic oligonucleotide
gaggctaactatggcagggcttttg

SEQ ID NO: 736795 - DNA, 25 bp, Artificial sequence
  Synthetic oligonucleotide
caattaagcatagtgatgaacaaca

SEQ ID NO: 736796 - DNA, 25 bp, Artificial sequence
  Synthetic oligonucleotide
ggcggaactctgttgacacaatcat

SEQ ID NO: 736797 - DNA, 25 bp, Artificial sequence
  Synthetic oligonucleotide
catgtagacaaaagaaattaggaat

SEQ ID NO: 736798 - DNA, 25 bp, Artificial sequence
  Synthetic oligonucleotide
tagtaactttgacggaacaataaac

SEQ ID NO: 736799 - DNA, 25 bp, Artificial sequence
  Synthetic oligonucleotide
gctctctttcgagaagaatctaaaa

SEQ ID NO: 736800 - DNA, 25 bp, Artificial sequence
  Synthetic oligonucleotide
gcaaaacagacattgttggcctcag

SEQ ID NO: 736801 - DNA, 25 bp, Artificial sequence
  Synthetic oligonucleotide
cggttaatgagtgtacaagagaaca

SEQ ID NO: 736802 - DNA, 25 bp, Artificial sequence
  Synthetic oligonucleotide
cggttaatgagtctacaagagaaca

SEQ ID NO: 736803 - DNA, 25 bp, Artificial sequence
  Synthetic oligonucleotide
tcccggaaagtttcgaagctcccat

SEQ ID NO: 736804 - DNA, 25 bp, Artificial sequence
  Synthetic oligonucleotide
gcagcttagaaatagaatattcagc

SEQ ID NO: 736805 - DNA, 25 bp, Artificial sequence
  Synthetic oligonucleotide
tatggtcactagagcaacaagctat

SEQ ID NO: 736806 - DNA, 25 bp, Artificial sequence
  Synthetic oligonucleotide
catgtagacaaatgaaattaggaat

SEQ ID NO: 736807 - DNA, 25 bp, Artificial sequence
  Synthetic oligonucleotide
caattaagcatactgatgaacaaca

SEQ ID NO: 736808 - DNA, 25 bp, Artificial sequence
  Synthetic oligonucleotide
gcaaaacagacaatgttggcctcag

SEQ ID NO: 736809 - DNA, 25 bp, Artificial sequence
  Synthetic oligonucleotide
tgtcatgttactgcatttttcaagc

SEQ ID NO: 736810 - DNA, 25 bp, Artificial sequence
  Synthetic oligonucleotide
tgtcatgttactccatttttcaagc

SEQ ID NO: 736811 - DNA, 25 bp, Artificial sequence
  Synthetic oligonucleotide
taaacaaagacctaacaaaacaagc

SEQ ID NO: 736812 - DNA, 25 bp, Artificial sequence
  Synthetic oligonucleotide
gcagcttagaaaaagaatattcagc

SEQ ID NO: 736813 - DNA, 25 bp, Artificial sequence
  Synthetic oligonucleotide
gccttgtcataaactacacttctta

SEQ ID NO: 736814 - DNA, 25 bp, Artificial sequence
  Synthetic oligonucleotide
tcaggttttagatgtaacgaccttg

SEQ ID NO: 736815 - DNA, 25 bp, Artificial sequence
  Synthetic oligonucleotide
actataggacaatactgaatccgga

SEQ ID NO: 736816 - DNA, 25 bp, Artificial sequence
  Synthetic oligonucleotide
actataggacaaaactgaatccgga

SEQ ID NO: 736817 - DNA, 25 bp, Artificial sequence
  Synthetic oligonucleotide
aaatctgaggccaaatagcactaag

SEQ ID NO: 736818 - DNA, 25 bp, Artificial sequence
  Synthetic oligonucleotide
aaatctgaggcctaatagcactaag

SEQ ID NO: 736819 - DNA, 25 bp, Artificial sequence
  Synthetic oligonucleotide
tgtcgcattcacttgtaaagcaaga

SEQ ID NO: 736820 - DNA, 25 bp, Artificial sequence
  Synthetic oligonucleotide
cacactaggtaattgcttagacata

SEQ ID NO: 736821 - DNA, 25 bp, Artificial sequence
  Synthetic oligonucleotide
aacggagcactagaccattgactgg

SEQ ID NO: 736822 - DNA, 25 bp, Artificial sequence
  Synthetic oligonucleotide
gccttgtcataatctacacttctta

SEQ ID NO: 736823 - DNA, 25 bp, Artificial sequence
  Synthetic oligonucleotide
tatgatgtacaacacattggtaatt

SEQ ID NO: 736824 - DNA, 25 bp, Artificial sequence
  Synthetic oligonucleotide
tatgatgtacaagacattggtaatt

SEQ ID NO: 736825 - DNA, 25 bp, Artificial sequence
  Synthetic oligonucleotide
gatcttgtcctcttttgttcccttt

SEQ ID NO: 736826 - DNA, 25 bp, Artificial sequence
  Synthetic oligonucleotide
gatcttgtcctcatttgttcccttt

SEQ ID NO: 736827 - DNA, 25 bp, Artificial sequence
  Synthetic oligonucleotide
tggtttatttttctcctttgtgtaa

SEQ ID NO: 736828 - DNA, 25 bp, Artificial sequence
  Synthetic oligonucleotide
cacactaggtaaatgcttagacata

SEQ ID NO: 736829 - DNA, 25 bp, Artificial sequence
  Synthetic oligonucleotide
cataattgtgtgaaagtgtatatat

SEQ ID NO: 736830 - DNA, 25 bp, Artificial sequence
  Synthetic oligonucleotide
tatggtcactagtgcaacaagctat

SEQ ID NO: 736831 - DNA, 25 bp, Artificial sequence
  Synthetic oligonucleotide
ggaaaacgaatcaatttcctcagct

SEQ ID NO: 736832 - DNA, 25 bp, Artificial sequence
  Synthetic oligonucleotide
ggaaaacgaatctatttcctcagct

SEQ ID NO: 736833 - DNA, 25 bp, Artificial sequence
  Synthetic oligonucleotide
gaacatccatcaacatacatacata

SEQ ID NO: 736834 - DNA, 25 bp, Artificial sequence
  Synthetic oligonucleotide
gaacatccatcatcatacatacata

SEQ ID NO: 736835 - DNA, 25 bp, Artificial sequence
  Synthetic oligonucleotide
tgtcgcattcacatgtaaagcaaga

SEQ ID NO: 736836 - DNA, 25 bp, Artificial sequence
  Synthetic oligonucleotide
tgtgatcacaatactctttatttta

SEQ ID NO: 736837 - DNA, 25 bp, Artificial sequence
  Synthetic oligonucleotide
tggtttatttttgtcctttgtgtaa

SEQ ID NO: 736838 - DNA, 25 bp, Artificial sequence
  Synthetic oligonucleotide
cataattgtgtgtaagtgtatatat

SEQ ID NO: 736839 - DNA, 25 bp, Artificial sequence
  Synthetic oligonucleotide
gattgcaatctcaagactattagca

SEQ ID NO: 736840 - DNA, 25 bp, Artificial sequence
  Synthetic oligonucleotide
gattgcaatctctagactattagca

SEQ ID NO: 736841 - DNA, 25 bp, Artificial sequence
  Synthetic oligonucleotide
gatgaaatctgaaacattgcttctc

SEQ ID NO: 736842 - DNA, 25 bp, Artificial sequence
  Synthetic oligonucleotide
gatgaaatctgatacattgcttctc

SEQ ID NO: 736843 - DNA, 25 bp, Artificial sequence
  Synthetic oligonucleotide
aacggagcactacaccattgactgg

SEQ ID NO: 736844 - DNA, 25 bp, Artificial sequence
  Synthetic oligonucleotide
tgtgatcacaattctctttatttta

SEQ ID NO: 736845 - DNA, 25 bp, Artificial sequence
  Synthetic oligonucleotide
catcgtgtggcgatcagagagttaa

SEQ ID NO: 736846 - DNA, 25 bp, Artificial sequence
  Synthetic oligonucleotide
cgtatgaagaagagtgtagaagtat

SEQ ID NO: 736847 - DNA, 25 bp, Artificial sequence
  Synthetic oligonucleotide
cgtatgaagaagtgtgtagaagtat

SEQ ID NO: 736848 - DNA, 25 bp, Artificial sequence
  Synthetic oligonucleotide
gaatggcttaccacaatcctcaaaa

SEQ ID NO: 736849 - DNA, 25 bp, Artificial sequence
  Synthetic oligonucleotide
gaatggcttacctcaatcctcaaaa

SEQ ID NO: 736850 - DNA, 25 bp, Artificial sequence
  Synthetic oligonucleotide
caatgattttcctaagcatatgtgg

SEQ ID NO: 736851 - DNA, 25 bp, Artificial sequence
  Synthetic oligonucleotide
caatgattttccaaagcatatgtgg

SEQ ID NO: 736852 - DNA, 25 bp, Artificial sequence
  Synthetic oligonucleotide
taatgttataatgttcacttgaaaa

SEQ ID NO: 736853 - DNA, 25 bp, Artificial sequence
  Synthetic oligonucleotide
taatgttataatcttcacttgaaaa

SEQ ID NO: 736854 - DNA, 25 bp, Artificial sequence
  Synthetic oligonucleotide
cattggcacagattagccatttgac

SEQ ID NO: 736855 - DNA, 25 bp, Artificial sequence
  Synthetic oligonucleotide
cattggcacagaatagccatttgac

SEQ ID NO: 736856 - DNA, 25 bp, Artificial sequence
  Synthetic oligonucleotide
taaacatattcctcgtggaccaatc

SEQ ID NO: 736857 - DNA, 25 bp, Artificial sequence
  Synthetic oligonucleotide
taaacatattccacgtggaccaatc

SEQ ID NO: 736858 - DNA, 25 bp, Artificial sequence
  Synthetic oligonucleotide
tcctaatcatcttcctcgtggcaac

SEQ ID NO: 736859 - DNA, 25 bp, Artificial sequence
  Synthetic oligonucleotide
tctccattagtgctttaatgttact

SEQ ID NO: 736860 - DNA, 25 bp, Artificial sequence
  Synthetic oligonucleotide
taagcttcttcttctaccaatctaa

SEQ ID NO: 736861 - DNA, 25 bp, Artificial sequence
  Synthetic oligonucleotide
ttattttaaaacaagtaaattcata

SEQ ID NO: 736862 - DNA, 25 bp, Artificial sequence
  Synthetic oligonucleotide
gtgccatcaacagagctccggtaca

SEQ ID NO: 736863 - DNA, 25 bp, Artificial sequence
  Synthetic oligonucleotide
gtgccatcaacacagctccggtaca

SEQ ID NO: 736864 - DNA, 25 bp, Artificial sequence
  Synthetic oligonucleotide
agtcttgagataaggccgccgcagt

SEQ ID NO: 736865 - DNA, 25 bp, Artificial sequence
  Synthetic oligonucleotide
agtcttgagatatggccgccgcagt

SEQ ID NO: 736866 - DNA, 25 bp, Artificial sequence
  Synthetic oligonucleotide
tcctaatcatctacctcgtggcaac

SEQ ID NO: 736867 - DNA, 25 bp, Artificial sequence
  Synthetic oligonucleotide
cagcttcttgtgatgtgacgcatac

SEQ ID NO: 736868 - DNA, 25 bp, Artificial sequence
  Synthetic oligonucleotide
catcgtgtggcgttcagagagttaa

SEQ ID NO: 736869 - DNA, 25 bp, Artificial sequence
  Synthetic oligonucleotide
taagcttcttctactaccaatctaa

SEQ ID NO: 736870 - DNA, 25 bp, Artificial sequence
  Synthetic oligonucleotide
taaatctctcagattcttgctcaca

SEQ ID NO: 736871 - DNA, 25 bp, Artificial sequence
  Synthetic oligonucleotide
taaatctctcagtttcttgctcaca

SEQ ID NO: 736872 - DNA, 25 bp, Artificial sequence
  Synthetic oligonucleotide
cgaagagataaccaattggttgttg

SEQ ID NO: 736873 - DNA, 25 bp, Artificial sequence
  Synthetic oligonucleotide
cgaagagataacgaattggttgttg

SEQ ID NO: 736874 - DNA, 25 bp, Artificial sequence
  Synthetic oligonucleotide
acatcggttattaggaacattatta

SEQ ID NO: 736875 - DNA, 25 bp, Artificial sequence
  Synthetic oligonucleotide
cagcttcttgtgttgtgacgcatac

SEQ ID NO: 736876 - DNA, 25 bp, Artificial sequence
  Synthetic oligonucleotide
tgtgaatatatagttttagatgagt

SEQ ID NO: 736877 - DNA, 25 bp, Artificial sequence
  Synthetic oligonucleotide
gcaatgtcattatccaaaattttgg

SEQ ID NO: 736878 - DNA, 25 bp, Artificial sequence
  Synthetic oligonucleotide
tataatcttatttcatattttagca

SEQ ID NO: 736879 - DNA, 25 bp, Artificial sequence
  Synthetic oligonucleotide
gatatattcatattttcactatgaa

SEQ ID NO: 736880 - DNA, 25 bp, Artificial sequence
  Synthetic oligonucleotide
gatatattcataatttcactatgaa

SEQ ID NO: 736881 - DNA, 25 bp, Artificial sequence
  Synthetic oligonucleotide
ttattttaaaactagtaaattcata

SEQ ID NO: 736882 - DNA, 25 bp, Artificial sequence
  Synthetic oligonucleotide
tgcatgatgctaacttagcctcgac

SEQ ID NO: 736883 - DNA, 25 bp, Artificial sequence
  Synthetic oligonucleotide
tgtgaatatatacttttagatgagt

SEQ ID NO: 736884 - DNA, 25 bp, Artificial sequence
  Synthetic oligonucleotide
tgcatgatgctatcttagcctcgac

SEQ ID NO: 736885 - DNA, 25 bp, Artificial sequence
  Synthetic oligonucleotide
tttatagcttagtgtagaaaacgat

SEQ ID NO: 736886 - DNA, 25 bp, Artificial sequence
  Synthetic oligonucleotide
tttatagcttagagtagaaaacgat

SEQ ID NO: 736887 - DNA, 25 bp, Artificial sequence
  Synthetic oligonucleotide
ggatgagaaattataatgatcagac

SEQ ID NO: 736888 - DNA, 25 bp, Artificial sequence
  Synthetic oligonucleotide
ggatgagaaattttaatgatcagac

SEQ ID NO: 736889 - DNA, 25 bp, Artificial sequence
  Synthetic oligonucleotide
cacatgagagaatggttgagaaaac

SEQ ID NO: 736890 - DNA, 25 bp, Artificial sequence
  Synthetic oligonucleotide
cacatgagagaaaggttgagaaaac

SEQ ID NO: 736891 - DNA, 25 bp, Artificial sequence
  Synthetic oligonucleotide
tagtaactttgagggaacaataaac

SEQ ID NO: 736892 - DNA, 25 bp, Artificial sequence
  Synthetic oligonucleotide
ggttaatttgataaccacatacttg

SEQ ID NO: 736893 - DNA, 25 bp, Artificial sequence
  Synthetic oligonucleotide
ttaacgctttgtccttatccaccac

SEQ ID NO: 736894 - DNA, 25 bp, Artificial sequence
  Synthetic oligonucleotide
acatcggttatttggaacattatta

SEQ ID NO: 736895 - DNA, 25 bp, Artificial sequence
  Synthetic oligonucleotide
tattggctaagccaatttctctcca

SEQ ID NO: 736896 - DNA, 25 bp, Artificial sequence
  Synthetic oligonucleotide
tattggctaagcgaatttctctcca

SEQ ID NO: 736897 - DNA, 25 bp, Artificial sequence
  Synthetic oligonucleotide
gtatctagagttgtatataacaaaa

SEQ ID NO: 736898 - DNA, 25 bp, Artificial sequence
  Synthetic oligonucleotide
tataatcttattacatattttagca

SEQ ID NO: 736899 - DNA, 25 bp, Artificial sequence
  Synthetic oligonucleotide
ggttaatttgattaccacatacttg

SEQ ID NO: 736900 - DNA, 25 bp, Artificial sequence
  Synthetic oligonucleotide
gcaatgtcattaaccaaaattttgg

SEQ ID NO: 736901 - DNA, 25 bp, Artificial sequence
  Synthetic oligonucleotide
aagttgcattaaatagtttttagcg

SEQ ID NO: 736902 - DNA, 25 bp, Artificial sequence
  Synthetic oligonucleotide
aagttgcattaattagtttttagcg

SEQ ID NO: 736903 - DNA, 25 bp, Artificial sequence
  Synthetic oligonucleotide
tatgcattgcatcacttgtttttac

SEQ ID NO: 736904 - DNA, 25 bp, Artificial sequence
  Synthetic oligonucleotide
tatgcattgcatgacttgtttttac

SEQ ID NO: 736905 - DNA, 25 bp, Artificial sequence
  Synthetic oligonucleotide
tacttcatcttcaaaactatatatt

SEQ ID NO: 736906 - DNA, 25 bp, Artificial sequence
  Synthetic oligonucleotide
tacttcatcttctaaactatatatt

SEQ ID NO: 736907 - DNA, 25 bp, Artificial sequence
  Synthetic oligonucleotide
gtatctagagttctatataacaaaa

SEQ ID NO: 736908 - DNA, 25 bp, Artificial sequence
  Synthetic oligonucleotide
ccacgctgtccttagctcatacgaa

SEQ ID NO: 736909 - DNA, 25 bp, Artificial sequence
  Synthetic oligonucleotide
cagatggagaggtcttgcctacgac

SEQ ID NO: 736910 - DNA, 25 bp, Artificial sequence
  Synthetic oligonucleotide
tttaaaaattgtgtttacttcttga

SEQ ID NO: 736911 - DNA, 25 bp, Artificial sequence
  Synthetic oligonucleotide
tttaaaaattgtctttacttcttga

SEQ ID NO: 736912 - DNA, 25 bp, Artificial sequence
  Synthetic oligonucleotide
tagatctctcattagttccataaag

SEQ ID NO: 736913 - DNA, 25 bp, Artificial sequence
  Synthetic oligonucleotide
tagatctctcataagttccataaag

SEQ ID NO: 736914 - DNA, 25 bp, Artificial sequence
  Synthetic oligonucleotide
caacttggacaagatgatggatggg

SEQ ID NO: 736915 - DNA, 25 bp, Artificial sequence
  Synthetic oligonucleotide
caaggccttaggcagtaagttctca

SEQ ID NO: 736916 - DNA, 25 bp, Artificial sequence
  Synthetic oligonucleotide
gctcctgctttcttggacaagcttg

SEQ ID NO: 736917 - DNA, 25 bp, Artificial sequence
  Synthetic oligonucleotide
ccacgctgtcctaagctcatacgaa

SEQ ID NO: 736918 - DNA, 25 bp, Artificial sequence
  Synthetic oligonucleotide
ctctgtcttccaagctcctatggga

SEQ ID NO: 736919 - DNA, 25 bp, Artificial sequence
  Synthetic oligonucleotide
ctctgtcttccatgctcctatggga

SEQ ID NO: 736920 - DNA, 25 bp, Artificial sequence
  Synthetic oligonucleotide
tcaacaagacatcaccagaggcaag

SEQ ID NO: 736921 - DNA, 25 bp, Artificial sequence
  Synthetic oligonucleotide
tcaacaagacatgaccagaggcaag

SEQ ID NO: 736922 - DNA, 25 bp, Artificial sequence
  Synthetic oligonucleotide
tctccattagtggtttaatgttact

SEQ ID NO: 736923 - DNA, 25 bp, Artificial sequence
  Synthetic oligonucleotide
caaggccttagggagtaagttctca

SEQ ID NO: 736924 - DNA, 25 bp, Artificial sequence
  Synthetic oligonucleotide
cacaactttattgatctttaaatgc

SEQ ID NO: 736925 - DNA, 25 bp, Artificial sequence
  Synthetic oligonucleotide
caaatctccgatcttgacccggttt

SEQ ID NO: 736926 - DNA, 25 bp, Artificial sequence
  Synthetic oligonucleotide
tcatggccaagaagggtatcaagtg

SEQ ID NO: 736927 - DNA, 25 bp, Artificial sequence
  Synthetic oligonucleotide
tcatggccaagatgggtatcaagtg

SEQ ID NO: 736928 - DNA, 25 bp, Artificial sequence
  Synthetic oligonucleotide
gcaaaggtcaaggtaaatccttcca

SEQ ID NO: 736929 - DNA, 25 bp, Artificial sequence
  Synthetic oligonucleotide
gcaaaggtcaagctaaatccttcca

SEQ ID NO: 736930 - DNA, 25 bp, Artificial sequence
  Synthetic oligonucleotide
caacttggacaacatgatggatggg

SEQ ID NO: 736931 - DNA, 25 bp, Artificial sequence
  Synthetic oligonucleotide
tctcataggttcgacttattttggg

SEQ ID NO: 736932 - DNA, 25 bp, Artificial sequence
  Synthetic oligonucleotide
tgttggctgtgatagaagacaaaca

SEQ ID NO: 736933 - DNA, 25 bp, Artificial sequence
  Synthetic oligonucleotide
cacaactttattcatctttaaatgc

SEQ ID NO: 736934 - DNA, 25 bp, Artificial sequence
  Synthetic oligonucleotide
ttttcttttgagaattttttggtgc

SEQ ID NO: 736935 - DNA, 25 bp, Artificial sequence
  Synthetic oligonucleotide
ttttcttttgagtattttttggtgc

SEQ ID NO: 736936 - DNA, 25 bp, Artificial sequence
  Synthetic oligonucleotide
caagaacttcttgactctgcctaac

SEQ ID NO: 736937 - DNA, 25 bp, Artificial sequence
  Synthetic oligonucleotide
caagaacttcttcactctgcctaac

SEQ ID NO: 736938 - DNA, 25 bp, Artificial sequence
  Synthetic oligonucleotide
gctcctgctttcatggacaagcttg

SEQ ID NO: 736939 - DNA, 25 bp, Artificial sequence
  Synthetic oligonucleotide
tctcataggttccacttattttggg

SEQ ID NO: 736940 - DNA, 25 bp, Artificial sequence
  Synthetic oligonucleotide
tcaggactttaagtaggaaatctaa

SEQ ID NO: 736941 - DNA, 25 bp, Artificial sequence
  Synthetic oligonucleotide
cagatggagaggacttgcctacgac

SEQ ID NO: 736942 - DNA, 25 bp, Artificial sequence
  Synthetic oligonucleotide
ttgaactgaaactgtagagactact

SEQ ID NO: 736943 - DNA, 25 bp, Artificial sequence
  Synthetic oligonucleotide
ttgaactgaaacagtagagactact

SEQ ID NO: 736944 - DNA, 25 bp, Artificial sequence
  Synthetic oligonucleotide
tagtagatgtgtttaaatcgatgta

SEQ ID NO: 736945 - DNA, 25 bp, Artificial sequence
  Synthetic oligonucleotide
tagtagatgtgtataaatcgatgta

SEQ ID NO: 736946 - DNA, 25 bp, Artificial sequence
  Synthetic oligonucleotide
gtcttcaggacttgtctataccttg

SEQ ID NO: 736947 - DNA, 25 bp, Artificial sequence
  Synthetic oligonucleotide
tgcttcttttatactctacttgtga

SEQ ID NO: 736948 - DNA, 25 bp, Artificial sequence
  Synthetic oligonucleotide
cggtttggttcggttcagttcctga

SEQ ID NO: 736949 - DNA, 25 bp, Artificial sequence
  Synthetic oligonucleotide
tcaggactttaactaggaaatctaa

SEQ ID NO: 736950 - DNA, 25 bp, Artificial sequence
  Synthetic oligonucleotide
gaatcactttgagattctctgacag

SEQ ID NO: 736951 - DNA, 25 bp, Artificial sequence
  Synthetic oligonucleotide
gaatcactttgacattctctgacag

SEQ ID NO: 736952 - DNA, 25 bp, Artificial sequence
  Synthetic oligonucleotide
ggtttttacaaatatagctcaagaa

SEQ ID NO: 736953 - DNA, 25 bp, Artificial sequence
  Synthetic oligonucleotide
ggtttttacaaaaatagctcaagaa

SEQ ID NO: 736954 - DNA, 25 bp, Artificial sequence
  Synthetic oligonucleotide
ttaacgctttgtgcttatccaccac

SEQ ID NO: 736955 - DNA, 25 bp, Artificial sequence
  Synthetic oligonucleotide
tgcttcttttattctctacttgtga

SEQ ID NO: 736956 - DNA, 25 bp, Artificial sequence
  Synthetic oligonucleotide
ttttgtgtgtgtcttgcagttgagc

SEQ ID NO: 736957 - DNA, 25 bp, Artificial sequence
  Synthetic oligonucleotide
tgttggctgtgaaagaagacaaaca

SEQ ID NO: 736958 - DNA, 25 bp, Artificial sequence
  Synthetic oligonucleotide
cacagagcaacatgaagagcaacgg

SEQ ID NO: 736959 - DNA, 25 bp, Artificial sequence
  Synthetic oligonucleotide
cacagagcaacaagaagagcaacgg

SEQ ID NO: 736960 - DNA, 25 bp, Artificial sequence
  Synthetic oligonucleotide
tcttgggaaagatagttgtaactgt

SEQ ID NO: 736961 - DNA, 25 bp, Artificial sequence
  Synthetic oligonucleotide
tcttgggaaagaaagttgtaactgt

SEQ ID NO: 736962 - DNA, 25 bp, Artificial sequence
  Synthetic oligonucleotide
gtcttcaggactagtctataccttg

SEQ ID NO: 736963 - DNA, 25 bp, Artificial sequence
  Synthetic oligonucleotide
tcaggatcaggagctgtatcagccc

SEQ ID NO: 736964 - DNA, 25 bp, Artificial sequence
  Synthetic oligonucleotide
caaatctccgatgttgacccggttt

SEQ ID NO: 736965 - DNA, 25 bp, Artificial sequence
  Synthetic oligonucleotide
ttttgtgtgtgtgttgcagttgagc

SEQ ID NO: 736966 - DNA, 25 bp, Artificial sequence
  Synthetic oligonucleotide
taaaccaaacttgaattcatgattg

SEQ ID NO: 736967 - DNA, 25 bp, Artificial sequence
  Synthetic oligonucleotide
taaaccaaacttcaattcatgattg

SEQ ID NO: 736968 - DNA, 25 bp, Artificial sequence
  Synthetic oligonucleotide
tccttaggaatagtctctaaaccgg

SEQ ID NO: 736969 - DNA, 25 bp, Artificial sequence
  Synthetic oligonucleotide
tccttaggaatactctctaaaccgg

SEQ ID NO: 736970 - DNA, 25 bp, Artificial sequence
  Synthetic oligonucleotide
cggtttggttcgcttcagttcctga

SEQ ID NO: 736971 - DNA, 25 bp, Artificial sequence
  Synthetic oligonucleotide
tcaggatcaggacctgtatcagccc

SEQ ID NO: 736972 - DNA, 25 bp, Artificial sequence
  Synthetic oligonucleotide
tagattactctgatttgatgacatg

SEQ ID NO: 736973 - DNA, 25 bp, Artificial sequence
  Synthetic oligonucleotide
tgtgtaatgaaacacagatttgtga

SEQ ID NO: 736974 - DNA, 25 bp, Artificial sequence
  Synthetic oligonucleotide
cgtttgtaggatactgtgtgcaaca

SEQ ID NO: 736975 - DNA, 25 bp, Artificial sequence
  Synthetic oligonucleotide
cgtttgtaggattctgtgtgcaaca

SEQ ID NO: 736976 - DNA, 25 bp, Artificial sequence
  Synthetic oligonucleotide
gacaggaccattggagaacttggca

SEQ ID NO: 736977 - DNA, 25 bp, Artificial sequence
  Synthetic oligonucleotide
gacaggaccattcgagaacttggca

SEQ ID NO: 736978 - DNA, 25 bp, Artificial sequence
  Synthetic oligonucleotide
gatccatggcacaacaacattggcg

SEQ ID NO: 736979 - DNA, 25 bp, Artificial sequence
  Synthetic oligonucleotide
gatccatggcactacaacattggcg

SEQ ID NO: 736980 - DNA, 25 bp, Artificial sequence
  Synthetic oligonucleotide
tatccctttcaactaatgaatgtaa

SEQ ID NO: 736981 - DNA, 25 bp, Artificial sequence
  Synthetic oligonucleotide
tatccctttcaagtaatgaatgtaa

SEQ ID NO: 736982 - DNA, 25 bp, Artificial sequence
  Synthetic oligonucleotide
agtttaatctaatggacttggtggg

SEQ ID NO: 736983 - DNA, 25 bp, Artificial sequence
  Synthetic oligonucleotide
tgtgtaccttatgagctttatgtgt

SEQ ID NO: 736984 - DNA, 25 bp, Artificial sequence
  Synthetic oligonucleotide
tgtacaaatgtaaatctaatgttgg

SEQ ID NO: 736985 - DNA, 25 bp, Artificial sequence
  Synthetic oligonucleotide
tgtgtaatgaaagacagatttgtga

SEQ ID NO: 736986 - DNA, 25 bp, Artificial sequence
  Synthetic oligonucleotide
ttgtcttggtgatcgaatgctcgtg

SEQ ID NO: 736987 - DNA, 25 bp, Artificial sequence
  Synthetic oligonucleotide
ttgtcttggtgaacgaatgctcgtg

SEQ ID NO: 736988 - DNA, 25 bp, Artificial sequence
  Synthetic oligonucleotide
taagtgatgaacgttttgaacccaa

SEQ ID NO: 736989 - DNA, 25 bp, Artificial sequence
  Synthetic oligonucleotide
taagtgatgaaccttttgaacccaa

SEQ ID NO: 736990 - DNA, 25 bp, Artificial sequence
  Synthetic oligonucleotide
tctcatgcttccaacagaagaaaca

SEQ ID NO: 736991 - DNA, 25 bp, Artificial sequence
  Synthetic oligonucleotide
tctcatgcttcctacagaagaaaca

SEQ ID NO: 736992 - DNA, 25 bp, Artificial sequence
  Synthetic oligonucleotide
catgactatttgttagatttctcaa

SEQ ID NO: 736993 - DNA, 25 bp, Artificial sequence
  Synthetic oligonucleotide
catgactatttgatagatttctcaa

SEQ ID NO: 736994 - DNA, 25 bp, Artificial sequence
  Synthetic oligonucleotide
tgtgtaccttatcagctttatgtgt

SEQ ID NO: 736995 - DNA, 25 bp, Artificial sequence
  Synthetic oligonucleotide
gaccctgagaagaagaagtacccgg

SEQ ID NO: 736996 - DNA, 25 bp, Artificial sequence
  Synthetic oligonucleotide
agtttaatctaaaggacttggtggg

SEQ ID NO: 736997 - DNA, 25 bp, Artificial sequence
  Synthetic oligonucleotide
cctgggattttggtaccagaagcat

SEQ ID NO: 736998 - DNA, 25 bp, Artificial sequence
  Synthetic oligonucleotide
cctgggattttgctaccagaagcat

SEQ ID NO: 736999 - DNA, 25 bp, Artificial sequence
  Synthetic oligonucleotide
gaaactgggttaaggctcaggaatg

SEQ ID NO: 737000 - DNA, 25 bp, Artificial sequence
  Synthetic oligonucleotide
gaaactgggttatggctcaggaatg

SEQ ID NO: 737001 - DNA, 25 bp, Artificial sequence
  Synthetic oligonucleotide
gggtcaagccacatacttgggaaac

SEQ ID NO: 737002 - DNA, 25 bp, Artificial sequence
  Synthetic oligonucleotide
gggtcaagccacttacttgggaaac

SEQ ID NO: 737003 - DNA, 25 bp, Artificial sequence
  Synthetic oligonucleotide
ggtactttgccctcaatcttggcca

SEQ ID NO: 737004 - DNA, 25 bp, Artificial sequence
  Synthetic oligonucleotide
ggtactttgcccacaatcttggcca

SEQ ID NO: 737005 - DNA, 25 bp, Artificial sequence
  Synthetic oligonucleotide
cttggtgggtgtaacagggcggctt

SEQ ID NO: 737006 - DNA, 25 bp, Artificial sequence
  Synthetic oligonucleotide
gccattgcatttgttgagcaccaga

SEQ ID NO: 737007 - DNA, 25 bp, Artificial sequence
  Synthetic oligonucleotide
cttggtgggtgttacagggcggctt

SEQ ID NO: 737008 - DNA, 25 bp, Artificial sequence
  Synthetic oligonucleotide
gaccctgagaagtagaagtacccgg

SEQ ID NO: 737009 - DNA, 25 bp, Artificial sequence
  Synthetic oligonucleotide
gaccctcttggatactcgaaggacc

SEQ ID NO: 737010 - DNA, 25 bp, Artificial sequence
  Synthetic oligonucleotide
gaccctcttggaaactcgaaggacc

SEQ ID NO: 737011 - DNA, 25 bp, Artificial sequence
  Synthetic oligonucleotide
cgaggaattgaaagttaaagagatc

SEQ ID NO: 737012 - DNA, 25 bp, Artificial sequence
  Synthetic oligonucleotide
cgaggaattgaatgttaaagagatc

SEQ ID NO: 737013 - DNA, 25 bp, Artificial sequence
  Synthetic oligonucleotide
taagcacacacaacaacttaccttt

SEQ ID NO: 737014 - DNA, 25 bp, Artificial sequence
  Synthetic oligonucleotide
taagcacacacatcaacttaccttt

SEQ ID NO: 737015 - DNA, 25 bp, Artificial sequence
  Synthetic oligonucleotide
tgtacaaatgtatatctaatgttgg

SEQ ID NO: 737016 - DNA, 25 bp, Artificial sequence
  Synthetic oligonucleotide
catgattatttgatagagttctcaa

SEQ ID NO: 737017 - DNA, 25 bp, Artificial sequence
  Synthetic oligonucleotide
gccattgcatttcttgagcaccaga

SEQ ID NO: 737018 - DNA, 25 bp, Artificial sequence
  Synthetic oligonucleotide
aaattttcaccaatctcttccaata

SEQ ID NO: 737019 - DNA, 25 bp, Artificial sequence
  Synthetic oligonucleotide
catactataaacaccataacagaag

SEQ ID NO: 737020 - DNA, 25 bp, Artificial sequence
  Synthetic oligonucleotide
ttgagctagaatatgaagaaaaatc

SEQ ID NO: 737021 - DNA, 25 bp, Artificial sequence
  Synthetic oligonucleotide
ttgagctagaatttgaagaaaaatc

SEQ ID NO: 737022 - DNA, 25 bp, Artificial sequence
  Synthetic oligonucleotide
ttacagattttatttcatatatggc

SEQ ID NO: 737023 - DNA, 25 bp, Artificial sequence
  Synthetic oligonucleotide
ttacagattttaattcatatatggc

SEQ ID NO: 737024 - DNA, 25 bp, Artificial sequence
  Synthetic oligonucleotide
tatatgattttctcaatttaattca

SEQ ID NO: 737025 - DNA, 25 bp, Artificial sequence
  Synthetic oligonucleotide
tatatgattttcacaatttaattca

SEQ ID NO: 737026 - DNA, 25 bp, Artificial sequence
  Synthetic oligonucleotide
tcaagtaatcagaatttcaaataat

SEQ ID NO: 737027 - DNA, 25 bp, Artificial sequence
  Synthetic oligonucleotide
tcaagtaatcagtatttcaaataat

SEQ ID NO: 737028 - DNA, 25 bp, Artificial sequence
  Synthetic oligonucleotide
acatctttgacaatcaatggttccc

SEQ ID NO: 737029 - DNA, 25 bp, Artificial sequence
  Synthetic oligonucleotide
cttaaagaaaacattagatttgaca

SEQ ID NO: 737030 - DNA, 25 bp, Artificial sequence
  Synthetic oligonucleotide
tcaactataaagattaaatgagaca

SEQ ID NO: 737031 - DNA, 25 bp, Artificial sequence
  Synthetic oligonucleotide
aaattttcaccattctcttccaata

SEQ ID NO: 737032 - DNA, 25 bp, Artificial sequence
  Synthetic oligonucleotide
ggagctatcttcctaatcatatcca

SEQ ID NO: 737033 - DNA, 25 bp, Artificial sequence
  Synthetic oligonucleotide
ggagctatcttcgtaatcatatcca

SEQ ID NO: 737034 - DNA, 25 bp, Artificial sequence
  Synthetic oligonucleotide
tgagatagaaacatgagctgcgtgg

SEQ ID NO: 737035 - DNA, 25 bp, Artificial sequence
  Synthetic oligonucleotide
tgagatagaaacttgagctgcgtgg

SEQ ID NO: 737036 - DNA, 25 bp, Artificial sequence
  Synthetic oligonucleotide
ttttttctgtctcattgacccaaag

SEQ ID NO: 737037 - DNA, 25 bp, Artificial sequence
  Synthetic oligonucleotide
ttttttctgtctgattgacccaaag

SEQ ID NO: 737038 - DNA, 25 bp, Artificial sequence
  Synthetic oligonucleotide
taaagagtattccaattggccgacg

SEQ ID NO: 737039 - DNA, 25 bp, Artificial sequence
  Synthetic oligonucleotide
tactctgttttgttgctcagtttgg

SEQ ID NO: 737040 - DNA, 25 bp, Artificial sequence
  Synthetic oligonucleotide
cttaaagaaaactttagatttgaca

SEQ ID NO: 737041 - DNA, 25 bp, Artificial sequence
  Synthetic oligonucleotide
tcttttctagtaaaatcatttaagg

SEQ ID NO: 737042 - DNA, 25 bp, Artificial sequence
  Synthetic oligonucleotide
catttgagttttcatgaatattttc

SEQ ID NO: 737043 - DNA, 25 bp, Artificial sequence
  Synthetic oligonucleotide
catgattatttgttagagttctcaa

SEQ ID NO: 737044 - DNA, 25 bp, Artificial sequence
  Synthetic oligonucleotide
ccaaatatgctttttgtttatatca

SEQ ID NO: 737045 - DNA, 25 bp, Artificial sequence
  Synthetic oligonucleotide
ccaaatatgcttattgtttatatca

SEQ ID NO: 737046 - DNA, 25 bp, Artificial sequence
  Synthetic oligonucleotide
ggttattgaacctcaccaagataca

SEQ ID NO: 737047 - DNA, 25 bp, Artificial sequence
  Synthetic oligonucleotide
ggttattgaaccacaccaagataca

SEQ ID NO: 737048 - DNA, 25 bp, Artificial sequence
  Synthetic oligonucleotide
catttgagttttgatgaatattttc

SEQ ID NO: 737049 - DNA, 25 bp, Artificial sequence
  Synthetic oligonucleotide
ttccccctcattattaccttctaca

SEQ ID NO: 737050 - DNA, 25 bp, Artificial sequence
  Synthetic oligonucleotide
catattgaacaaaaacaatcctgtt

SEQ ID NO: 737051 - DNA, 25 bp, Artificial sequence
  Synthetic oligonucleotide
acatctttgacattcaatggttccc

SEQ ID NO: 737052 - DNA, 25 bp, Artificial sequence
  Synthetic oligonucleotide
tcttttctagtataatcatttaagg

SEQ ID NO: 737053 - DNA, 25 bp, Artificial sequence
  Synthetic oligonucleotide
catactataaactccataacagaag

SEQ ID NO: 737054 - DNA, 25 bp, Artificial sequence
  Synthetic oligonucleotide
aattagttgatgtctttcttatcac

SEQ ID NO: 737055 - DNA, 25 bp, Artificial sequence
  Synthetic oligonucleotide
aattagttgatgactttcttatcac

SEQ ID NO: 737056 - DNA, 25 bp, Artificial sequence
  Synthetic oligonucleotide
tatacttctactaatttttcttttg

SEQ ID NO: 737057 - DNA, 25 bp, Artificial sequence
  Synthetic oligonucleotide
tatacttctacttatttttcttttg

SEQ ID NO: 737058 - DNA, 25 bp, Artificial sequence
  Synthetic oligonucleotide
taatcttcacctacaaaatagagta

SEQ ID NO: 737059 - DNA, 25 bp, Artificial sequence
  Synthetic oligonucleotide
taatcttcaccttcaaaatagagta

SEQ ID NO: 737060 - DNA, 25 bp, Artificial sequence
  Synthetic oligonucleotide
cagagtcttggatagttttgtcttc

SEQ ID NO: 737061 - DNA, 25 bp, Artificial sequence
  Synthetic oligonucleotide
cagagtcttggaaagttttgtcttc

SEQ ID NO: 737062 - DNA, 25 bp, Artificial sequence
  Synthetic oligonucleotide
tcaactataaagtttaaatgagaca

SEQ ID NO: 737063 - DNA, 25 bp, Artificial sequence
  Synthetic oligonucleotide
catattgaacaataacaatcctgtt

SEQ ID NO: 737064 - DNA, 25 bp, Artificial sequence
  Synthetic oligonucleotide
tgttcgttgatccaagttttaccgg

SEQ ID NO: 737065 - DNA, 25 bp, Artificial sequence
  Synthetic oligonucleotide
aatagtaatataggtagattctgct

SEQ ID NO: 737066 - DNA, 25 bp, Artificial sequence
  Synthetic oligonucleotide
tatgctcattcatatcctgattgag

SEQ ID NO: 737067 - DNA, 25 bp, Artificial sequence
  Synthetic oligonucleotide
gaaacttagttcgaaagattctgaa

SEQ ID NO: 737068 - DNA, 25 bp, Artificial sequence
  Synthetic oligonucleotide
gaaacttagttccaaagattctgaa

SEQ ID NO: 737069 - DNA, 25 bp, Artificial sequence
  Synthetic oligonucleotide
acagtgtgtctggaaatggtattct

SEQ ID NO: 737070 - DNA, 25 bp, Artificial sequence
  Synthetic oligonucleotide
acagtgtgtctgcaaatggtattct

SEQ ID NO: 737071 - DNA, 25 bp, Artificial sequence
  Synthetic oligonucleotide
tgtctaaacacgttgtctcaaaatg

SEQ ID NO: 737072 - DNA, 25 bp, Artificial sequence
  Synthetic oligonucleotide
tgtctaaacacgatgtctcaaaatg

SEQ ID NO: 737073 - DNA, 25 bp, Artificial sequence
  Synthetic oligonucleotide
tagatactcctttcaagacatatga

SEQ ID NO: 737074 - DNA, 25 bp, Artificial sequence
  Synthetic oligonucleotide
ttgtttctgacttagagacatgaag

SEQ ID NO: 737075 - DNA, 25 bp, Artificial sequence
  Synthetic oligonucleotide
tgttcgttgatcgaagttttaccgg

SEQ ID NO: 737076 - DNA, 25 bp, Artificial sequence
  Synthetic oligonucleotide
ttgtttctgactaagagacatgaag

SEQ ID NO: 737077 - DNA, 25 bp, Artificial sequence
  Synthetic oligonucleotide
tctccagtcttaccaataaatccag

SEQ ID NO: 737078 - DNA, 25 bp, Artificial sequence
  Synthetic oligonucleotide
tctccagtcttagcaataaatccag

SEQ ID NO: 737079 - DNA, 25 bp, Artificial sequence
  Synthetic oligonucleotide
caatcgcagatttaccggtccgggt

SEQ ID NO: 737080 - DNA, 25 bp, Artificial sequence
  Synthetic oligonucleotide
caatcgcagattaaccggtccgggt

SEQ ID NO: 737081 - DNA, 25 bp, Artificial sequence
  Synthetic oligonucleotide
cattagtagaaaagtgtttcaccga

SEQ ID NO: 737082 - DNA, 25 bp, Artificial sequence
  Synthetic oligonucleotide
cattagtagaaatgtgtttcaccga

SEQ ID NO: 737083 - DNA, 25 bp, Artificial sequence
  Synthetic oligonucleotide
tatctgatagcatctcgttgcagtg

SEQ ID NO: 737084 - DNA, 25 bp, Artificial sequence
  Synthetic oligonucleotide
tatctgatagcaactcgttgcagtg

SEQ ID NO: 737085 - DNA, 25 bp, Artificial sequence
  Synthetic oligonucleotide
aatagtaatatacgtagattctgct

SEQ ID NO: 737086 - DNA, 25 bp, Artificial sequence
  Synthetic oligonucleotide
tagatactccttacaagacatatga

SEQ ID NO: 737087 - DNA, 25 bp, Artificial sequence
  Synthetic oligonucleotide
tatctatctatcaatcacctgggaa

SEQ ID NO: 737088 - DNA, 25 bp, Artificial sequence
  Synthetic oligonucleotide
taaagagtattcgaattggccgacg

SEQ ID NO: 737089 - DNA, 25 bp, Artificial sequence
  Synthetic oligonucleotide
tatatcggcggtgagtttttcggtg

SEQ ID NO: 737090 - DNA, 25 bp, Artificial sequence
  Synthetic oligonucleotide
ttccccctcatttttaccttctaca

SEQ ID NO: 737091 - DNA, 25 bp, Artificial sequence
  Synthetic oligonucleotide
tatccaatctttgtcttatcataag

SEQ ID NO: 737092 - DNA, 25 bp, Artificial sequence
  Synthetic oligonucleotide
tatatcggcggtcagtttttcggtg

SEQ ID NO: 737093 - DNA, 25 bp, Artificial sequence
  Synthetic oligonucleotide
tactcttgaggcgtttaagactgga

SEQ ID NO: 737094 - DNA, 25 bp, Artificial sequence
  Synthetic oligonucleotide
tactcttgaggcctttaagactgga

SEQ ID NO: 737095 - DNA, 25 bp, Artificial sequence
  Synthetic oligonucleotide
aagaggtggagatagctatgtgctc

SEQ ID NO: 737096 - DNA, 25 bp, Artificial sequence
  Synthetic oligonucleotide
aagaggtggagaaagctatgtgctc

SEQ ID NO: 737097 - DNA, 25 bp, Artificial sequence
  Synthetic oligonucleotide
tatgctcattcaaatcctgattgag

SEQ ID NO: 737098 - DNA, 25 bp, Artificial sequence
  Synthetic oligonucleotide
caatacttggtttttgtgatgatgg

SEQ ID NO: 737099 - DNA, 25 bp, Artificial sequence
  Synthetic oligonucleotide
ggtttatgtgtgtagtagtgctagt

SEQ ID NO: 737100 - DNA, 25 bp, Artificial sequence
  Synthetic oligonucleotide
tatctatctatctatcacctgggaa

SEQ ID NO: 737101 - DNA, 25 bp, Artificial sequence
  Synthetic oligonucleotide
gatgtttcagagattgtggttgtaa

SEQ ID NO: 737102 - DNA, 25 bp, Artificial sequence
  Synthetic oligonucleotide
gatgtttcagagtttgtggttgtaa

SEQ ID NO: 737103 - DNA, 25 bp, Artificial sequence
  Synthetic oligonucleotide
catatattgtatgatggatttaggt

SEQ ID NO: 737104 - DNA, 25 bp, Artificial sequence
  Synthetic oligonucleotide
catatattgtatcatggatttaggt

SEQ ID NO: 737105 - DNA, 25 bp, Artificial sequence
  Synthetic oligonucleotide
ggagttgcttggaatttgagtttcc

SEQ ID NO: 737106 - DNA, 25 bp, Artificial sequence
  Synthetic oligonucleotide
ggagttgcttggtatttgagtttcc

SEQ ID NO: 737107 - DNA, 25 bp, Artificial sequence
  Synthetic oligonucleotide
tgtgttggcctggaaatttgtgttg

SEQ ID NO: 737108 - DNA, 25 bp, Artificial sequence
  Synthetic oligonucleotide
ggtttatgtgtgaagtagtgctagt

SEQ ID NO: 737109 - DNA, 25 bp, Artificial sequence
  Synthetic oligonucleotide
caatacttggttattgtgatgatgg

SEQ ID NO: 737110 - DNA, 25 bp, Artificial sequence
  Synthetic oligonucleotide
cagtttttctaagttattgggtaca

SEQ ID NO: 737111 - DNA, 25 bp, Artificial sequence
  Synthetic oligonucleotide
ccttgacggttctgctcctgggtac

SEQ ID NO: 737112 - DNA, 25 bp, Artificial sequence
  Synthetic oligonucleotide
tactctgttttgatgctcagtttgg

SEQ ID NO: 737113 - DNA, 25 bp, Artificial sequence
  Synthetic oligonucleotide
tagattactctgttttgatgacatg

SEQ ID NO: 737114 - DNA, 25 bp, Artificial sequence
  Synthetic oligonucleotide
cattgtacgtttagtgaaagattca

SEQ ID NO: 737115 - DNA, 25 bp, Artificial sequence
  Synthetic oligonucleotide
cattgtacgttttgtgaaagattca

SEQ ID NO: 737116 - DNA, 25 bp, Artificial sequence
  Synthetic oligonucleotide
tattgggtattcttatttcagaaag

SEQ ID NO: 737117 - DNA, 25 bp, Artificial sequence
  Synthetic oligonucleotide
tattgggtattcatatttcagaaag

SEQ ID NO: 737118 - DNA, 25 bp, Artificial sequence
  Synthetic oligonucleotide
cagaatttgaattccctttagttgt

SEQ ID NO: 737119 - DNA, 25 bp, Artificial sequence
  Synthetic oligonucleotide
ttctagatagattactggaacctct

SEQ ID NO: 737120 - DNA, 25 bp, Artificial sequence
  Synthetic oligonucleotide
ccttgacggttcagctcctgggtac

SEQ ID NO: 737121 - DNA, 25 bp, Artificial sequence
  Synthetic oligonucleotide
aagggttctgatatcaacattggag

SEQ ID NO: 737122 - DNA, 25 bp, Artificial sequence
  Synthetic oligonucleotide
cagaatttgaataccctttagttgt

SEQ ID NO: 737123 - DNA, 25 bp, Artificial sequence
  Synthetic oligonucleotide
cagtttttctaacttattgggtaca

SEQ ID NO: 737124 - DNA, 25 bp, Artificial sequence
  Synthetic oligonucleotide
gactttgggtttgacccacttggac

SEQ ID NO: 737125 - DNA, 25 bp, Artificial sequence
  Synthetic oligonucleotide
gactttgggtttcacccacttggac

SEQ ID NO: 737126 - DNA, 25 bp, Artificial sequence
  Synthetic oligonucleotide
ccagcgaaccttcagagatacaaag

SEQ ID NO: 737127 - DNA, 25 bp, Artificial sequence
  Synthetic oligonucleotide
cacatagtgcagatggatatcgaac

SEQ ID NO: 737128 - DNA, 25 bp, Artificial sequence
  Synthetic oligonucleotide
tgtgttggcctgcaaatttgtgttg

SEQ ID NO: 737129 - DNA, 25 bp, Artificial sequence
  Synthetic oligonucleotide
ccagcgaaccttgagagatacaaag

SEQ ID NO: 737130 - DNA, 25 bp, Artificial sequence
  Synthetic oligonucleotide
tccactgtagatcggctatgctcgc

SEQ ID NO: 737131 - DNA, 25 bp, Artificial sequence
  Synthetic oligonucleotide
tccactgtagatgggctatgctcgc

SEQ ID NO: 737132 - DNA, 25 bp, Artificial sequence
  Synthetic oligonucleotide
tatccaatctttctcttatcataag

SEQ ID NO: 737133 - DNA, 25 bp, Artificial sequence
  Synthetic oligonucleotide
aagggttctgatttcaacattggag

SEQ ID NO: 737134 - DNA, 25 bp, Artificial sequence
  Synthetic oligonucleotide
ctcccacattcacacttccaccaaa

SEQ ID NO: 737135 - DNA, 25 bp, Artificial sequence
  Synthetic oligonucleotide
tgatatcgagaacacacgtggccca

SEQ ID NO: 737136 - DNA, 25 bp, Artificial sequence
  Synthetic oligonucleotide
cgcaggctctgtttagccaattgca

SEQ ID NO: 737137 - DNA, 25 bp, Artificial sequence
  Synthetic oligonucleotide
cgcaggctctgtatagccaattgca

SEQ ID NO: 737138 - DNA, 25 bp, Artificial sequence
  Synthetic oligonucleotide
ttctagatagataactggaacctct

SEQ ID NO: 737139 - DNA, 25 bp, Artificial sequence
  Synthetic oligonucleotide
tgatatcgagaagacacgtggccca

SEQ ID NO: 737140 - DNA, 25 bp, Artificial sequence
  Synthetic oligonucleotide
tgctcactggatccctggcgagcca

SEQ ID NO: 737141 - DNA, 25 bp, Artificial sequence
  Synthetic oligonucleotide
cacatagtgcagttggatatcgaac

SEQ ID NO: 737142 - DNA, 25 bp, Artificial sequence
  Synthetic oligonucleotide
gattctcatctcacaaatcttactt

SEQ ID NO: 737143 - DNA, 25 bp, Artificial sequence
  Synthetic oligonucleotide
ctcccacattcagacttccaccaaa

SEQ ID NO: 737144 - DNA, 25 bp, Artificial sequence
  Synthetic oligonucleotide
gattctcatctctcaaatcttactt

SEQ ID NO: 737145 - DNA, 25 bp, Artificial sequence
  Synthetic oligonucleotide
cacatctttctcgtttggtggcaaa

SEQ ID NO: 737146 - DNA, 25 bp, Artificial sequence
  Synthetic oligonucleotide
cacatctttctcctttggtggcaaa

SEQ ID NO: 737147 - DNA, 25 bp, Artificial sequence
  Synthetic oligonucleotide
tcttccaagtcttaattcgtatccg

SEQ ID NO: 737148 - DNA, 25 bp, Artificial sequence
  Synthetic oligonucleotide
tgctcactggatgcctggcgagcca

SEQ ID NO: 737149 - DNA, 25 bp, Artificial sequence
  Synthetic oligonucleotide
ccaaacgccgggtatgttggtcgta

SEQ ID NO: 737150 - DNA, 25 bp, Artificial sequence
  Synthetic oligonucleotide
ccaaacgccgggaatgttggtcgta

SEQ ID NO: 737151 - DNA, 25 bp, Artificial sequence
  Synthetic oligonucleotide
tcttccaagtctaaattcgtatccg

SEQ ID NO: 737152 - DNA, 25 bp, Artificial sequence
  Synthetic oligonucleotide
gagctgtggcatagccgccgtgtac

SEQ ID NO: 737153 - DNA, 25 bp, Artificial sequence
  Synthetic oligonucleotide
gagctgtggcattgccgccgtgtac

SEQ ID NO: 737154 - DNA, 25 bp, Artificial sequence
  Synthetic oligonucleotide
tagagagaaacgatggcgtcgaact

SEQ ID NO: 737155 - DNA, 25 bp, Artificial sequence
  Synthetic oligonucleotide
tagagagaaacgttggcgtcgaact

SEQ ID NO: 737156 - DNA, 25 bp, Artificial sequence
  Synthetic oligonucleotide
tacggagaagtctctcaacaaatgc

SEQ ID NO: 737157 - DNA, 25 bp, Artificial sequence
  Synthetic oligonucleotide
gagcagctcattgccaacaaagcca

SEQ ID NO: 737158 - DNA, 25 bp, Artificial sequence
  Synthetic oligonucleotide
cgtggaaagtcacttgagcaacctc

SEQ ID NO: 737159 - DNA, 25 bp, Artificial sequence
  Synthetic oligonucleotide
tacggagaagtcactcaacaaatgc

SEQ ID NO: 737160 - DNA, 25 bp, Artificial sequence
  Synthetic oligonucleotide
ggatggacaatttgatagactggac

SEQ ID NO: 737161 - DNA, 25 bp, Artificial sequence
  Synthetic oligonucleotide
gatttcccgggttgcaacaacggta

SEQ ID NO: 737162 - DNA, 25 bp, Artificial sequence
  Synthetic oligonucleotide
cgtggaaagtcagttgagcaacctc

SEQ ID NO: 737163 - DNA, 25 bp, Artificial sequence
  Synthetic oligonucleotide
caaaccattgttggattgaagatca

SEQ ID NO: 737164 - DNA, 25 bp, Artificial sequence
  Synthetic oligonucleotide
caaaccattgttcgattgaagatca

SEQ ID NO: 737165 - DNA, 25 bp, Artificial sequence
  Synthetic oligonucleotide
ggatggacaattagatagactggac

SEQ ID NO: 737166 - DNA, 25 bp, Artificial sequence
  Synthetic oligonucleotide
gagcagctcattcccaacaaagcca

SEQ ID NO: 737167 - DNA, 25 bp, Artificial sequence
  Synthetic oligonucleotide
gatttcccgggtagcaacaacggta

SEQ ID NO: 737168 - DNA, 25 bp, Artificial sequence
  Synthetic oligonucleotide
gctaaagcctaatacaaacgaagcg

SEQ ID NO: 737169 - DNA, 25 bp, Artificial sequence
  Synthetic oligonucleotide
gctaaagcctaaaacaaacgaagcg

SEQ ID NO: 737170 - DNA, 25 bp, Artificial sequence
  Synthetic oligonucleotide
tagaacgcgtcgataaatacatccg

SEQ ID NO: 737171 - DNA, 25 bp, Artificial sequence
  Synthetic oligonucleotide
tagaacgcgtcgttaaatacatccg

SEQ ID NO: 737172 - DNA, 25 bp, Artificial sequence
  Synthetic oligonucleotide
tcttatttctttgtttctttatgcg

SEQ ID NO: 737173 - DNA, 25 bp, Artificial sequence
  Synthetic oligonucleotide
tttcatggcgaataggacggtcttg

SEQ ID NO: 737174 - DNA, 25 bp, Artificial sequence
  Synthetic oligonucleotide
tttcatggcgaaaaggacggtcttg

SEQ ID NO: 737175 - DNA, 25 bp, Artificial sequence
  Synthetic oligonucleotide
tgtggagataaatagaaaaagcctg

SEQ ID NO: 737176 - DNA, 25 bp, Artificial sequence
  Synthetic oligonucleotide
ccttcaaaatttgttctttacagca

SEQ ID NO: 737177 - DNA, 25 bp, Artificial sequence
  Synthetic oligonucleotide
gaatagcagagcaataacagttcag

SEQ ID NO: 737178 - DNA, 25 bp, Artificial sequence
  Synthetic oligonucleotide
tatctccctttttgtttctctcagg

SEQ ID NO: 737179 - DNA, 25 bp, Artificial sequence
  Synthetic oligonucleotide
gatcagtttatattattttcaatgg

SEQ ID NO: 737180 - DNA, 25 bp, Artificial sequence
  Synthetic oligonucleotide
tgtggagataaaaagaaaaagcctg

SEQ ID NO: 737181 - DNA, 25 bp, Artificial sequence
  Synthetic oligonucleotide
gaatagcagagctataacagttcag

SEQ ID NO: 737182 - DNA, 25 bp, Artificial sequence
  Synthetic oligonucleotide
tcttatttctttctttctttatgcg

SEQ ID NO: 737183 - DNA, 25 bp, Artificial sequence
  Synthetic oligonucleotide
gaaagtgttgagagtgagattgata

SEQ ID NO: 737184 - DNA, 25 bp, Artificial sequence
  Synthetic oligonucleotide
ttggagagcatcaaagcgagtatcg

SEQ ID NO: 737185 - DNA, 25 bp, Artificial sequence
  Synthetic oligonucleotide
ttggagagcatctaagcgagtatcg

SEQ ID NO: 737186 - DNA, 25 bp, Artificial sequence
  Synthetic oligonucleotide
cttagttataagcacctgatgaatc

SEQ ID NO: 737187 - DNA, 25 bp, Artificial sequence
  Synthetic oligonucleotide
ccttcaaaatttcttctttacagca

SEQ ID NO: 737188 - DNA, 25 bp, Artificial sequence
  Synthetic oligonucleotide
gaaagcccgacttcgatgcattcat

SEQ ID NO: 737189 - DNA, 25 bp, Artificial sequence
  Synthetic oligonucleotide
gaaagcccgactacgatgcattcat

SEQ ID NO: 737190 - DNA, 25 bp, Artificial sequence
  Synthetic oligonucleotide
taatttcttgatgtaaccccgtgtc

SEQ ID NO: 737191 - DNA, 25 bp, Artificial sequence
  Synthetic oligonucleotide
taatttcttgatctaaccccgtgtc

SEQ ID NO: 737192 - DNA, 25 bp, Artificial sequence
  Synthetic oligonucleotide
gatcagtttataatattttcaatgg

SEQ ID NO: 737193 - DNA, 25 bp, Artificial sequence
  Synthetic oligonucleotide
cgcaaaagcagtacgcggatgcggt

SEQ ID NO: 737194 - DNA, 25 bp, Artificial sequence
  Synthetic oligonucleotide
tgcttcctacgactctgatcccaga

SEQ ID NO: 737195 - DNA, 25 bp, Artificial sequence
  Synthetic oligonucleotide
cgcaaaagcagttcgcggatgcggt

SEQ ID NO: 737196 - DNA, 25 bp, Artificial sequence
  Synthetic oligonucleotide
gaaagtgttgagtgtgagattgata

SEQ ID NO: 737197 - DNA, 25 bp, Artificial sequence
  Synthetic oligonucleotide
tatctcccttttagtttctctcagg

SEQ ID NO: 737198 - DNA, 25 bp, Artificial sequence
  Synthetic oligonucleotide
tgttaagtacttgagcccggtttac

SEQ ID NO: 737199 - DNA, 25 bp, Artificial sequence
  Synthetic oligonucleotide
tgttaagtacttcagcccggtttac

SEQ ID NO: 737200 - DNA, 25 bp, Artificial sequence
  Synthetic oligonucleotide
gaaggttcaaccttctcgtggattc

SEQ ID NO: 737201 - DNA, 25 bp, Artificial sequence
  Synthetic oligonucleotide
gaaggttcaaccatctcgtggattc

SEQ ID NO: 737202 - DNA, 25 bp, Artificial sequence
  Synthetic oligonucleotide
aaactcacttgcacgtaccctggca

SEQ ID NO: 737203 - DNA, 25 bp, Artificial sequence
  Synthetic oligonucleotide
aaactcacttgctcgtaccctggca

SEQ ID NO: 737204 - DNA, 25 bp, Artificial sequence
  Synthetic oligonucleotide
gaacctgactccaacttcgaccatg

SEQ ID NO: 737205 - DNA, 25 bp, Artificial sequence
  Synthetic oligonucleotide
gaacctgactcctacttcgaccatg

SEQ ID NO: 737206 - DNA, 25 bp, Artificial sequence
  Synthetic oligonucleotide
tattgcataatgacatattgtgaga

SEQ ID NO: 737207 - DNA, 25 bp, Artificial sequence
  Synthetic oligonucleotide
tattgcataatgtcatattgtgaga

SEQ ID NO: 737208 - DNA, 25 bp, Artificial sequence
  Synthetic oligonucleotide
aatgcatgtgtatgagaatttagac

SEQ ID NO: 737209 - DNA, 25 bp, Artificial sequence
  Synthetic oligonucleotide
aatgcatgtgtaagagaatttagac

SEQ ID NO: 737210 - DNA, 25 bp, Artificial sequence
  Synthetic oligonucleotide
tgcttcctacgagtctgatcccaga

SEQ ID NO: 737211 - DNA, 25 bp, Artificial sequence
  Synthetic oligonucleotide
tacacattgcttttagtgagtcaag

SEQ ID NO: 737212 - DNA, 25 bp, Artificial sequence
  Synthetic oligonucleotide
cacaaagcatttttattggcaagca

SEQ ID NO: 737213 - DNA, 25 bp, Artificial sequence
  Synthetic oligonucleotide
gcaaaaaccatatcatttgttttga

SEQ ID NO: 737214 - DNA, 25 bp, Artificial sequence
  Synthetic oligonucleotide
gcaaaaaccataacatttgttttga

SEQ ID NO: 737215 - DNA, 25 bp, Artificial sequence
  Synthetic oligonucleotide
tattcaggatcaacaagaacatccc

SEQ ID NO: 737216 - DNA, 25 bp, Artificial sequence
  Synthetic oligonucleotide
tattcaggatcatcaagaacatccc

SEQ ID NO: 737217 - DNA, 25 bp, Artificial sequence
  Synthetic oligonucleotide
ttaaaggcatgatccgacgtcgcac

SEQ ID NO: 737218 - DNA, 25 bp, Artificial sequence
  Synthetic oligonucleotide
ttaaaggcatgaaccgacgtcgcac

SEQ ID NO: 737219 - DNA, 25 bp, Artificial sequence
  Synthetic oligonucleotide
aataagcttcttctcctgctgcttc

SEQ ID NO: 737220 - DNA, 25 bp, Artificial sequence
  Synthetic oligonucleotide
aataagcttcttgtcctgctgcttc

SEQ ID NO: 737221 - DNA, 25 bp, Artificial sequence
  Synthetic oligonucleotide
gccttctgtgtcaaataacttctcc

SEQ ID NO: 737222 - DNA, 25 bp, Artificial sequence
  Synthetic oligonucleotide
gccttctgtgtctaataacttctcc

SEQ ID NO: 737223 - DNA, 25 bp, Artificial sequence
  Synthetic oligonucleotide
tacacattgcttatagtgagtcaag

SEQ ID NO: 737224 - DNA, 25 bp, Artificial sequence
  Synthetic oligonucleotide
gatgttcatcaatacatcctctttg

SEQ ID NO: 737225 - DNA, 25 bp, Artificial sequence
  Synthetic oligonucleotide
tgaaaacaaacagaaacaccaatta

SEQ ID NO: 737226 - DNA, 25 bp, Artificial sequence
  Synthetic oligonucleotide
cttagttataaggacctgatgaatc

SEQ ID NO: 737227 - DNA, 25 bp, Artificial sequence
  Synthetic oligonucleotide
gatgacttcatttcagaatgcaaag

SEQ ID NO: 737228 - DNA, 25 bp, Artificial sequence
  Synthetic oligonucleotide
gatgacttcattacagaatgcaaag

SEQ ID NO: 737229 - DNA, 25 bp, Artificial sequence
  Synthetic oligonucleotide
tataactattctacaaagcagcagc

SEQ ID NO: 737230 - DNA, 25 bp, Artificial sequence
  Synthetic oligonucleotide
tataactattcttcaaagcagcagc

SEQ ID NO: 737231 - DNA, 25 bp, Artificial sequence
  Synthetic oligonucleotide
ggtctccttggccatcccacctata

SEQ ID NO: 737232 - DNA, 25 bp, Artificial sequence
  Synthetic oligonucleotide
ggtctccttggcgatcccacctata

SEQ ID NO: 737233 - DNA, 25 bp, Artificial sequence
  Synthetic oligonucleotide
gataaccataaatgagagtttttga

SEQ ID NO: 737234 - DNA, 25 bp, Artificial sequence
  Synthetic oligonucleotide
gataaccataaaagagagtttttga

SEQ ID NO: 737235 - DNA, 25 bp, Artificial sequence
  Synthetic oligonucleotide
tggtcacagaggcacatggctgaaa

SEQ ID NO: 737236 - DNA, 25 bp, Artificial sequence
  Synthetic oligonucleotide
tacggtgacgtgaaaatgtgaccca

SEQ ID NO: 737237 - DNA, 25 bp, Artificial sequence
  Synthetic oligonucleotide
gatgttcatcaaaacatcctctttg

SEQ ID NO: 737238 - DNA, 25 bp, Artificial sequence
  Synthetic oligonucleotide
gttctgatagaattccacaactaca

SEQ ID NO: 737239 - DNA, 25 bp, Artificial sequence
  Synthetic oligonucleotide
tcaaaccacaaatcaactaagcaaa

SEQ ID NO: 737240 - DNA, 25 bp, Artificial sequence
  Synthetic oligonucleotide
tatcctattgatcatactcatgttg

SEQ ID NO: 737241 - DNA, 25 bp, Artificial sequence
  Synthetic oligonucleotide
tatcctattgatgatactcatgttg

SEQ ID NO: 737242 - DNA, 25 bp, Artificial sequence
  Synthetic oligonucleotide
tgtcaaatagcttttggattacaaa

SEQ ID NO: 737243 - DNA, 25 bp, Artificial sequence
  Synthetic oligonucleotide
tgtcaaatagctattggattacaaa

SEQ ID NO: 737244 - DNA, 25 bp, Artificial sequence
  Synthetic oligonucleotide
agttcaaacttccttatagattcca

SEQ ID NO: 737245 - DNA, 25 bp, Artificial sequence
  Synthetic oligonucleotide
agttcaaacttcgttatagattcca

SEQ ID NO: 737246 - DNA, 25 bp, Artificial sequence
  Synthetic oligonucleotide
gcaaagaaattatacatacaagtaa

SEQ ID NO: 737247 - DNA, 25 bp, Artificial sequence
  Synthetic oligonucleotide
gcaaagaaattaaacatacaagtaa

SEQ ID NO: 737248 - DNA, 25 bp, Artificial sequence
  Synthetic oligonucleotide
tgcaatcaccaactactactttggg

SEQ ID NO: 737249 - DNA, 25 bp, Artificial sequence
  Synthetic oligonucleotide
tgcaatcaccaagtactactttggg

SEQ ID NO: 737250 - DNA, 25 bp, Artificial sequence
  Synthetic oligonucleotide
cacaaagcatttatattggcaagca

SEQ ID NO: 737251 - DNA, 25 bp, Artificial sequence
  Synthetic oligonucleotide
gcctttgatgccatctggatcagcc

SEQ ID NO: 737252 - DNA, 25 bp, Artificial sequence
  Synthetic oligonucleotide
tgaaaacaaacacaaacaccaatta

SEQ ID NO: 737253 - DNA, 25 bp, Artificial sequence
  Synthetic oligonucleotide
gttctgatagaaatccacaactaca

SEQ ID NO: 737254 - DNA, 25 bp, Artificial sequence
  Synthetic oligonucleotide
cagattcaacaactaagtaagaaca

SEQ ID NO: 737255 - DNA, 25 bp, Artificial sequence
  Synthetic oligonucleotide
cagattcaacaagtaagtaagaaca

SEQ ID NO: 737256 - DNA, 25 bp, Artificial sequence
  Synthetic oligonucleotide
tgaccacaaaaattgcagattaaac

SEQ ID NO: 737257 - DNA, 25 bp, Artificial sequence
  Synthetic oligonucleotide
tgaccacaaaaaatgcagattaaac

SEQ ID NO: 737258 - DNA, 25 bp, Artificial sequence
  Synthetic oligonucleotide
ttaccttgactatctgcaaacagag

SEQ ID NO: 737259 - DNA, 25 bp, Artificial sequence
  Synthetic oligonucleotide
ttaccttgactaactgcaaacagag

SEQ ID NO: 737260 - DNA, 25 bp, Artificial sequence
  Synthetic oligonucleotide
caatatctctttgaagaagagccct

SEQ ID NO: 737261 - DNA, 25 bp, Artificial sequence
  Synthetic oligonucleotide
caatatctctttcaagaagagccct

SEQ ID NO: 737262 - DNA, 25 bp, Artificial sequence
  Synthetic oligonucleotide
caacaagagctttacctagcccttg

SEQ ID NO: 737263 - DNA, 25 bp, Artificial sequence
  Synthetic oligonucleotide
caacaagagcttaacctagcccttg

SEQ ID NO: 737264 - DNA, 25 bp, Artificial sequence
  Synthetic oligonucleotide
tcaaaccacaaaacaactaagcaaa

SEQ ID NO: 737265 - DNA, 25 bp, Artificial sequence
  Synthetic oligonucleotide
gcctttgatgccttctggatcagcc

SEQ ID NO: 737266 - DNA, 25 bp, Artificial sequence
  Synthetic oligonucleotide
aaataaaactccatttcttctctgc

SEQ ID NO: 737267 - DNA, 25 bp, Artificial sequence
  Synthetic oligonucleotide
tctccaaattatcttttagccaaaa

SEQ ID NO: 737268 - DNA, 25 bp, Artificial sequence
  Synthetic oligonucleotide
tctccaaattatgttttagccaaaa

SEQ ID NO: 737269 - DNA, 25 bp, Artificial sequence
  Synthetic oligonucleotide
accataagtttaatacttcatgaag

SEQ ID NO: 737270 - DNA, 25 bp, Artificial sequence
  Synthetic oligonucleotide
accataagtttattacttcatgaag

SEQ ID NO: 737271 - DNA, 25 bp, Artificial sequence
  Synthetic oligonucleotide
gatctttggttttttaatggctata

SEQ ID NO: 737272 - DNA, 25 bp, Artificial sequence
  Synthetic oligonucleotide
gatctttggtttattaatggctata

SEQ ID NO: 737273 - DNA, 25 bp, Artificial sequence
  Synthetic oligonucleotide
tcctcttatcttttcaacaacatct

SEQ ID NO: 737274 - DNA, 25 bp, Artificial sequence
  Synthetic oligonucleotide
tcctcttatcttatcaacaacatct

SEQ ID NO: 737275 - DNA, 25 bp, Artificial sequence
  Synthetic oligonucleotide
gagactaatcaacattacaaacaat

SEQ ID NO: 737276 - DNA, 25 bp, Artificial sequence
  Synthetic oligonucleotide
gagactaatcaagattacaaacaat

SEQ ID NO: 737277 - DNA, 25 bp, Artificial sequence
  Synthetic oligonucleotide
caagaaaccaaatcatgagccaatc

SEQ ID NO: 737278 - DNA, 25 bp, Artificial sequence
  Synthetic oligonucleotide
aaaaaaagagcttaggcggagaaga

SEQ ID NO: 737279 - DNA, 25 bp, Artificial sequence
  Synthetic oligonucleotide
aaataaaactccttttcttctctgc

SEQ ID NO: 737280 - DNA, 25 bp, Artificial sequence
  Synthetic oligonucleotide
aacgtctccctcgatgccctgttag

SEQ ID NO: 737281 - DNA, 25 bp, Artificial sequence
  Synthetic oligonucleotide
tgtttttcctatagacccattgtcc

SEQ ID NO: 737282 - DNA, 25 bp, Artificial sequence
  Synthetic oligonucleotide
tgtttttcctattgacccattgtcc

SEQ ID NO: 737283 - DNA, 25 bp, Artificial sequence
  Synthetic oligonucleotide
tctctctttccccatttaatcttat

SEQ ID NO: 737284 - DNA, 25 bp, Artificial sequence
  Synthetic oligonucleotide
tctctctttcccgatttaatcttat

SEQ ID NO: 737285 - DNA, 25 bp, Artificial sequence
  Synthetic oligonucleotide
aaaaatcacatctctatatcaccac

SEQ ID NO: 737286 - DNA, 25 bp, Artificial sequence
  Synthetic oligonucleotide
aaaaatcacatcactatatcaccac

SEQ ID NO: 737287 - DNA, 25 bp, Artificial sequence
  Synthetic oligonucleotide
taaaatcaaaaatcgttacccacat

SEQ ID NO: 737288 - DNA, 25 bp, Artificial sequence
  Synthetic oligonucleotide
taaaatcaaaaaacgttacccacat

SEQ ID NO: 737289 - DNA, 25 bp, Artificial sequence
  Synthetic oligonucleotide
taaatcctcatctctcaacctgagc

SEQ ID NO: 737290 - DNA, 25 bp, Artificial sequence
  Synthetic oligonucleotide
taaatcctcatcactcaacctgagc

SEQ ID NO: 737291 - DNA, 25 bp, Artificial sequence
  Synthetic oligonucleotide
tcatcttcagacgttaaacacctaa

SEQ ID NO: 737292 - DNA, 25 bp, Artificial sequence
  Synthetic oligonucleotide
caagaaaccaaaacatgagccaatc

SEQ ID NO: 737293 - DNA, 25 bp, Artificial sequence
  Synthetic oligonucleotide
cattgttaaggttacgcaagaaggc

SEQ ID NO: 737294 - DNA, 25 bp, Artificial sequence
  Synthetic oligonucleotide
tgtatggtggttcgtggagactacg

SEQ ID NO: 737295 - DNA, 25 bp, Artificial sequence
  Synthetic oligonucleotide
tgtatggtggttggtggagactacg

SEQ ID NO: 737296 - DNA, 25 bp, Artificial sequence
  Synthetic oligonucleotide
caagaataagcatctagtgccgact

SEQ ID NO: 737297 - DNA, 25 bp, Artificial sequence
  Synthetic oligonucleotide
caagaataagcaactagtgccgact

SEQ ID NO: 737298 - DNA, 25 bp, Artificial sequence
  Synthetic oligonucleotide
ggtcgataaataaaccatggttttg

SEQ ID NO: 737299 - DNA, 25 bp, Artificial sequence
  Synthetic oligonucleotide
ggtcgataaatataccatggttttg

SEQ ID NO: 737300 - DNA, 25 bp, Artificial sequence
  Synthetic oligonucleotide
aatcccgatgtattctcttttacta

SEQ ID NO: 737301 - DNA, 25 bp, Artificial sequence
  Synthetic oligonucleotide
aatcccgatgtaatctcttttacta

SEQ ID NO: 737302 - DNA, 25 bp, Artificial sequence
  Synthetic oligonucleotide
cggtgaaattcatgagtaataaact

SEQ ID NO: 737303 - DNA, 25 bp, Artificial sequence
  Synthetic oligonucleotide
cggtgaaattcaagagtaataaact

SEQ ID NO: 737304 - DNA, 25 bp, Artificial sequence
  Synthetic oligonucleotide
ctcttggtgtctatattaattggta

SEQ ID NO: 737305 - DNA, 25 bp, Artificial sequence
  Synthetic oligonucleotide
acttcatcggcatctccactcctct

SEQ ID NO: 737306 - DNA, 25 bp, Artificial sequence
  Synthetic oligonucleotide
cattgttaaggtaacgcaagaaggc

SEQ ID NO: 737307 - DNA, 25 bp, Artificial sequence
  Synthetic oligonucleotide
acttcatcggcaactccactcctct

SEQ ID NO: 737308 - DNA, 25 bp, Artificial sequence
  Synthetic oligonucleotide
ccctatagaaaaaaataaaagcata

SEQ ID NO: 737309 - DNA, 25 bp, Artificial sequence
  Synthetic oligonucleotide
ccctatagaaaataataaaagcata

SEQ ID NO: 737310 - DNA, 25 bp, Artificial sequence
  Synthetic oligonucleotide
tcaaagaccatatagattcgaagcc

SEQ ID NO: 737311 - DNA, 25 bp, Artificial sequence
  Synthetic oligonucleotide
tcaaagaccataaagattcgaagcc

SEQ ID NO: 737312 - DNA, 25 bp, Artificial sequence
  Synthetic oligonucleotide
tacggtgacgtgtaaatgtgaccca

SEQ ID NO: 737313 - DNA, 25 bp, Artificial sequence
  Synthetic oligonucleotide
tcatcttcagaccttaaacacctaa

SEQ ID NO: 737314 - DNA, 25 bp, Artificial sequence
  Synthetic oligonucleotide
tgtccaattagattctcccacgtgt

SEQ ID NO: 737315 - DNA, 25 bp, Artificial sequence
  Synthetic oligonucleotide
tgtccaattagaatctcccacgtgt

SEQ ID NO: 737316 - DNA, 25 bp, Artificial sequence
  Synthetic oligonucleotide
tatccaaatcccaaaaaaataagca

SEQ ID NO: 737317 - DNA, 25 bp, Artificial sequence
  Synthetic oligonucleotide
tatccaaatccctaaaaaataagca

SEQ ID NO: 737318 - DNA, 25 bp, Artificial sequence
  Synthetic oligonucleotide
aacgtctccctccatgccctgttag

SEQ ID NO: 737319 - DNA, 25 bp, Artificial sequence
  Synthetic oligonucleotide
caccaaacaaacaacaatggctgtc

SEQ ID NO: 737320 - DNA, 25 bp, Artificial sequence
  Synthetic oligonucleotide
ctcttggtgtctttattaattggta

SEQ ID NO: 737321 - DNA, 25 bp, Artificial sequence
  Synthetic oligonucleotide
gtctatagttttcgtacttgtaatg

SEQ ID NO: 737322 - DNA, 25 bp, Artificial sequence
  Synthetic oligonucleotide
cctaagattcttgtcatcgaaggtc

SEQ ID NO: 737323 - DNA, 25 bp, Artificial sequence
  Synthetic oligonucleotide
tgtaagctacacatactctgttatg

SEQ ID NO: 737324 - DNA, 25 bp, Artificial sequence
  Synthetic oligonucleotide
tgtaagctacacttactctgttatg

SEQ ID NO: 737325 - DNA, 25 bp, Artificial sequence
  Synthetic oligonucleotide
tcttagacatacacaaattttagag

SEQ ID NO: 737326 - DNA, 25 bp, Artificial sequence
  Synthetic oligonucleotide
tcttagacatactcaaattttagag

SEQ ID NO: 737327 - DNA, 25 bp, Artificial sequence
  Synthetic oligonucleotide
gtctcttatcttgtcggaatttcga

SEQ ID NO: 737328 - DNA, 25 bp, Artificial sequence
  Synthetic oligonucleotide
gtctcttatcttctcggaatttcga

SEQ ID NO: 737329 - DNA, 25 bp, Artificial sequence
  Synthetic oligonucleotide
ggacttagatttatactagaatcag

SEQ ID NO: 737330 - DNA, 25 bp, Artificial sequence
  Synthetic oligonucleotide
ggacttagatttttactagaatcag

SEQ ID NO: 737331 - DNA, 25 bp, Artificial sequence
  Synthetic oligonucleotide
taaagatggatcattgaatctatgc

SEQ ID NO: 737332 - DNA, 25 bp, Artificial sequence
  Synthetic oligonucleotide
taaagatggatctttgaatctatgc

SEQ ID NO: 737333 - DNA, 25 bp, Artificial sequence
  Synthetic oligonucleotide
aaaaaaagagctaaggcggagaaga

SEQ ID NO: 737334 - DNA, 25 bp, Artificial sequence
  Synthetic oligonucleotide
tgtgacaccgataaatttttattcg

SEQ ID NO: 737335 - DNA, 25 bp, Artificial sequence
  Synthetic oligonucleotide
tggacttcttgagcctccggagctt

SEQ ID NO: 737336 - DNA, 25 bp, Artificial sequence
  Synthetic oligonucleotide
gtctatagttttggtacttgtaatg

SEQ ID NO: 737337 - DNA, 25 bp, Artificial sequence
  Synthetic oligonucleotide
atctacttgtgaaggtttgatgagc

SEQ ID NO: 737338 - DNA, 25 bp, Artificial sequence
  Synthetic oligonucleotide
atctacttgtgatggtttgatgagc

SEQ ID NO: 737339 - DNA, 25 bp, Artificial sequence
  Synthetic oligonucleotide
tactagacttcagtatctacttgga

SEQ ID NO: 737340 - DNA, 25 bp, Artificial sequence
  Synthetic oligonucleotide
tactagacttcactatctacttgga

SEQ ID NO: 737341 - DNA, 25 bp, Artificial sequence
  Synthetic oligonucleotide
gtcaaattcgctaggaaaattcagg

SEQ ID NO: 737342 - DNA, 25 bp, Artificial sequence
  Synthetic oligonucleotide
gtcaaattcgcttggaaaattcagg

SEQ ID NO: 737343 - DNA, 25 bp, Artificial sequence
  Synthetic oligonucleotide
gaataattcaactacatttacacca

SEQ ID NO: 737344 - DNA, 25 bp, Artificial sequence
  Synthetic oligonucleotide
gaataattcaacaacatttacacca

SEQ ID NO: 737345 - DNA, 25 bp, Artificial sequence
  Synthetic oligonucleotide
cggtttatcttaaaaaactgaatct

SEQ ID NO: 737346 - DNA, 25 bp, Artificial sequence
  Synthetic oligonucleotide
cggtttatcttataaaactgaatct

SEQ ID NO: 737347 - DNA, 25 bp, Artificial sequence
  Synthetic oligonucleotide
tgtgacaccgattaatttttattcg

SEQ ID NO: 737348 - DNA, 25 bp, Artificial sequence
  Synthetic oligonucleotide
tgctaagccacctaaaggcgggaac

SEQ ID NO: 737349 - DNA, 25 bp, Artificial sequence
  Synthetic oligonucleotide
caccaaacaaactacaatggctgtc

SEQ ID NO: 737350 - DNA, 25 bp, Artificial sequence
  Synthetic oligonucleotide
tcaacacaagctctcaattcaactc

SEQ ID NO: 737351 - DNA, 25 bp, Artificial sequence
  Synthetic oligonucleotide
tcaacacaagctgtcaattcaactc

SEQ ID NO: 737352 - DNA, 25 bp, Artificial sequence
  Synthetic oligonucleotide
tcttcttcctccaccaaacaagtct

SEQ ID NO: 737353 - DNA, 25 bp, Artificial sequence
  Synthetic oligonucleotide
tcttcttcctcctccaaacaagtct

SEQ ID NO: 737354 - DNA, 25 bp, Artificial sequence
  Synthetic oligonucleotide
cgtcaaccacaaaccaaccgtagat

SEQ ID NO: 737355 - DNA, 25 bp, Artificial sequence
  Synthetic oligonucleotide
cgtcaaccacaatccaaccgtagat

SEQ ID NO: 737356 - DNA, 25 bp, Artificial sequence
  Synthetic oligonucleotide
tcacttgcgcactagaaaccatcgt

SEQ ID NO: 737357 - DNA, 25 bp, Artificial sequence
  Synthetic oligonucleotide
tcacttgcgcacaagaaaccatcgt

SEQ ID NO: 737358 - DNA, 25 bp, Artificial sequence
  Synthetic oligonucleotide
tgctgactctgggtgcggcaaaagt

SEQ ID NO: 737359 - DNA, 25 bp, Artificial sequence
  Synthetic oligonucleotide
tgctgactctggctgcggcaaaagt

SEQ ID NO: 737360 - DNA, 25 bp, Artificial sequence
  Synthetic oligonucleotide
cctaagattcttctcatcgaaggtc

SEQ ID NO: 737361 - DNA, 25 bp, Artificial sequence
  Synthetic oligonucleotide
atgcggaggctctccagcgtctttg

SEQ ID NO: 737362 - DNA, 25 bp, Artificial sequence
  Synthetic oligonucleotide
tggacttcttgaccctccggagctt

SEQ ID NO: 737363 - DNA, 25 bp, Artificial sequence
  Synthetic oligonucleotide
tgctaagccaccaaaaggcgggaac

SEQ ID NO: 737364 - DNA, 25 bp, Artificial sequence
  Synthetic oligonucleotide
actcatcagcgagacgaccactgtg

SEQ ID NO: 737365 - DNA, 25 bp, Artificial sequence
  Synthetic oligonucleotide
actcatcagcgacacgaccactgtg

SEQ ID NO: 737366 - DNA, 25 bp, Artificial sequence
  Synthetic oligonucleotide
gattaccattctttggataggtacg

SEQ ID NO: 737367 - DNA, 25 bp, Artificial sequence
  Synthetic oligonucleotide
gattaccattctatggataggtacg

SEQ ID NO: 737368 - DNA, 25 bp, Artificial sequence
  Synthetic oligonucleotide
agaaagtcaccggtttggacccacg

SEQ ID NO: 737369 - DNA, 25 bp, Artificial sequence
  Synthetic oligonucleotide
agaaagtcaccgctttggacccacg

SEQ ID NO: 737370 - DNA, 25 bp, Artificial sequence
  Synthetic oligonucleotide
tctcatgtatgagcaagtcaaagct

SEQ ID NO: 737371 - DNA, 25 bp, Artificial sequence
  Synthetic oligonucleotide
tctcatgtatgaccaagtcaaagct

SEQ ID NO: 737372 - DNA, 25 bp, Artificial sequence
  Synthetic oligonucleotide
tatagccgtcgagaaaccgatttat

SEQ ID NO: 737373 - DNA, 25 bp, Artificial sequence
  Synthetic oligonucleotide
tatagccgtcgacaaaccgatttat

SEQ ID NO: 737374 - DNA, 25 bp, Artificial sequence
  Synthetic oligonucleotide
tggtcacagagggacatggctgaaa

SEQ ID NO: 737375 - DNA, 25 bp, Artificial sequence
  Synthetic oligonucleotide
atgcggaggctcaccagcgtctttg

SEQ ID NO: 737376 - DNA, 25 bp, Artificial sequence
  Synthetic oligonucleotide
tataagctcttacgtttggagtgaa

SEQ ID NO: 737377 - DNA, 25 bp, Artificial sequence
  Synthetic oligonucleotide
tgataatatatagtatcggtacctt

SEQ ID NO: 737378 - DNA, 25 bp, Artificial sequence
  Synthetic oligonucleotide
tgataatatatactatcggtacctt

SEQ ID NO: 737379 - DNA, 25 bp, Artificial sequence
  Synthetic oligonucleotide
ttatagtttataaatctttccgcca

SEQ ID NO: 737380 - DNA, 25 bp, Artificial sequence
  Synthetic oligonucleotide
ttatagtttatatatctttccgcca

SEQ ID NO: 737381 - DNA, 25 bp, Artificial sequence
  Synthetic oligonucleotide
cgtaaaaatcatatagtgaagagtc

SEQ ID NO: 737382 - DNA, 25 bp, Artificial sequence
  Synthetic oligonucleotide
cgtaaaaatcatttagtgaagagtc

SEQ ID NO: 737383 - DNA, 25 bp, Artificial sequence
  Synthetic oligonucleotide
gcggtgttagcaacccctatcccat

SEQ ID NO: 737384 - DNA, 25 bp, Artificial sequence
  Synthetic oligonucleotide
taatattaagctgtttttaaacaac

SEQ ID NO: 737385 - DNA, 25 bp, Artificial sequence
  Synthetic oligonucleotide
tgtttgtcttgaaggctttgtaatc

SEQ ID NO: 737386 - DNA, 25 bp, Artificial sequence
  Synthetic oligonucleotide
tataagctcttaggtttggagtgaa

SEQ ID NO: 737387 - DNA, 25 bp, Artificial sequence
  Synthetic oligonucleotide
ttttgagattggtaaagtgtaaacc

SEQ ID NO: 737388 - DNA, 25 bp, Artificial sequence
  Synthetic oligonucleotide
ttttgagattggaaaagtgtaaacc

SEQ ID NO: 737389 - DNA, 25 bp, Artificial sequence
  Synthetic oligonucleotide
aatacgaagaaaaaatgttgaatgg

SEQ ID NO: 737390 - DNA, 25 bp, Artificial sequence
  Synthetic oligonucleotide
aatacgaagaaataatgttgaatgg

SEQ ID NO: 737391 - DNA, 25 bp, Artificial sequence
  Synthetic oligonucleotide
caattattaactaaccgacgacacg

SEQ ID NO: 737392 - DNA, 25 bp, Artificial sequence
  Synthetic oligonucleotide
caattattaacttaccgacgacacg

SEQ ID NO: 737393 - DNA, 25 bp, Artificial sequence
  Synthetic oligonucleotide
taatattaagctctttttaaacaac

SEQ ID NO: 737394 - DNA, 25 bp, Artificial sequence
  Synthetic oligonucleotide
tattgttgcagcttcaagtgaagtg

SEQ ID NO: 737395 - DNA, 25 bp, Artificial sequence
  Synthetic oligonucleotide
gcggtgttagcatcccctatcccat

SEQ ID NO: 737396 - DNA, 25 bp, Artificial sequence
  Synthetic oligonucleotide
ccaactgcgccaggtaagtttttaa

SEQ ID NO: 737397 - DNA, 25 bp, Artificial sequence
  Synthetic oligonucleotide
ccaactgcgccacgtaagtttttaa

SEQ ID NO: 737398 - DNA, 25 bp, Artificial sequence
  Synthetic oligonucleotide
agtactgctcatattctctctaata

SEQ ID NO: 737399 - DNA, 25 bp, Artificial sequence
  Synthetic oligonucleotide
agtactgctcattttctctctaata

SEQ ID NO: 737400 - DNA, 25 bp, Artificial sequence
  Synthetic oligonucleotide
acttggctaatttctcgatcttgag

SEQ ID NO: 737401 - DNA, 25 bp, Artificial sequence
  Synthetic oligonucleotide
acttggctaattactcgatcttgag

SEQ ID NO: 737402 - DNA, 25 bp, Artificial sequence
  Synthetic oligonucleotide
tatgttgtatacatgtgtcttaaca

SEQ ID NO: 737403 - DNA, 25 bp, Artificial sequence
  Synthetic oligonucleotide
ctttctagtgatgtaatttatactc

SEQ ID NO: 737404 - DNA, 25 bp, Artificial sequence
  Synthetic oligonucleotide
tatgttgtatacttgtgtcttaaca

SEQ ID NO: 737405 - DNA, 25 bp, Artificial sequence
  Synthetic oligonucleotide
tattgttgcagcatcaagtgaagtg

SEQ ID NO: 737406 - DNA, 25 bp, Artificial sequence
  Synthetic oligonucleotide
catttgcctgaagagtatggtttcg

SEQ ID NO: 737407 - DNA, 25 bp, Artificial sequence
  Synthetic oligonucleotide
catttgcctgaacagtatggtttcg

SEQ ID NO: 737408 - DNA, 25 bp, Artificial sequence
  Synthetic oligonucleotide
taagacggctatgtaagctgatatt

SEQ ID NO: 737409 - DNA, 25 bp, Artificial sequence
  Synthetic oligonucleotide
taagacggctatctaagctgatatt

SEQ ID NO: 737410 - DNA, 25 bp, Artificial sequence
  Synthetic oligonucleotide
tgtttgtcttgatggctttgtaatc

SEQ ID NO: 737411 - DNA, 25 bp, Artificial sequence
  Synthetic oligonucleotide
caaacaatatttaattgattaggac

SEQ ID NO: 737412 - DNA, 25 bp, Artificial sequence
  Synthetic oligonucleotide
ctttctagtgatctaatttatactc

SEQ ID NO: 737413 - DNA, 25 bp, Artificial sequence
  Synthetic oligonucleotide
cggaggtttccgttcctagagagga

SEQ ID NO: 737414 - DNA, 25 bp, Artificial sequence
  Synthetic oligonucleotide
tcaccagcataaatgaaaataaaat

SEQ ID NO: 737415 - DNA, 25 bp, Artificial sequence
  Synthetic oligonucleotide
aaacaaatcaaaacccaaatactca

SEQ ID NO: 737416 - DNA, 25 bp, Artificial sequence
  Synthetic oligonucleotide
aaacaaatcaaatcccaaatactca

SEQ ID NO: 737417 - DNA, 25 bp, Artificial sequence
  Synthetic oligonucleotide
caaaagttaatttcgagttagggca

SEQ ID NO: 737418 - DNA, 25 bp, Artificial sequence
  Synthetic oligonucleotide
caaaagttaattacgagttagggca

SEQ ID NO: 737419 - DNA, 25 bp, Artificial sequence
  Synthetic oligonucleotide
taatgacaccgatcggatatccgat

SEQ ID NO: 737420 - DNA, 25 bp, Artificial sequence
  Synthetic oligonucleotide
taatgacaccgaacggatatccgat

SEQ ID NO: 737421 - DNA, 25 bp, Artificial sequence
  Synthetic oligonucleotide
cataattttttttattcctttatca

SEQ ID NO: 737422 - DNA, 25 bp, Artificial sequence
  Synthetic oligonucleotide
tatcgcctctgtcaatcggtcgtac

SEQ ID NO: 737423 - DNA, 25 bp, Artificial sequence
  Synthetic oligonucleotide
caagaatttgtattgacataagtta

SEQ ID NO: 737424 - DNA, 25 bp, Artificial sequence
  Synthetic oligonucleotide
cggaggtttccgatcctagagagga

SEQ ID NO: 737425 - DNA, 25 bp, Artificial sequence
  Synthetic oligonucleotide
tacgctcttgtcacttcttgaatcc

SEQ ID NO: 737426 - DNA, 25 bp, Artificial sequence
  Synthetic oligonucleotide
tgggcggcgatacatccatcggcaa

SEQ ID NO: 737427 - DNA, 25 bp, Artificial sequence
  Synthetic oligonucleotide
gcaatctctgttgcggaaaaagcgc

SEQ ID NO: 737428 - DNA, 25 bp, Artificial sequence
  Synthetic oligonucleotide
gcaatctctgttccggaaaaagcgc

SEQ ID NO: 737429 - DNA, 25 bp, Artificial sequence
  Synthetic oligonucleotide
tcgtcaaatgttaaccaaagttatt

SEQ ID NO: 737430 - DNA, 25 bp, Artificial sequence
  Synthetic oligonucleotide
tcgtcaaatgtttaccaaagttatt

SEQ ID NO: 737431 - DNA, 25 bp, Artificial sequence
  Synthetic oligonucleotide
tatcgcctctgtgaatcggtcgtac

SEQ ID NO: 737432 - DNA, 25 bp, Artificial sequence
  Synthetic oligonucleotide
actaagtaagttttcatttggtatg

SEQ ID NO: 737433 - DNA, 25 bp, Artificial sequence
  Synthetic oligonucleotide
tacgctcttgtctcttcttgaatcc

SEQ ID NO: 737434 - DNA, 25 bp, Artificial sequence
  Synthetic oligonucleotide
caaacaatattttattgattaggac

SEQ ID NO: 737435 - DNA, 25 bp, Artificial sequence
  Synthetic oligonucleotide
cagtgttgttaactataatagaaaa

SEQ ID NO: 737436 - DNA, 25 bp, Artificial sequence
  Synthetic oligonucleotide
cagtgttgttaagtataatagaaaa

SEQ ID NO: 737437 - DNA, 25 bp, Artificial sequence
  Synthetic oligonucleotide
taaacatgcattattcaattattca

SEQ ID NO: 737438 - DNA, 25 bp, Artificial sequence
  Synthetic oligonucleotide
taaacatgcatttttcaattattca

SEQ ID NO: 737439 - DNA, 25 bp, Artificial sequence
  Synthetic oligonucleotide
gagatttcatcgagttgattatgaa

SEQ ID NO: 737440 - DNA, 25 bp, Artificial sequence
  Synthetic oligonucleotide
cataatttttttaattcctttatca

SEQ ID NO: 737441 - DNA, 25 bp, Artificial sequence
  Synthetic oligonucleotide
actaagtaagttatcatttggtatg

SEQ ID NO: 737442 - DNA, 25 bp, Artificial sequence
  Synthetic oligonucleotide
tcaccagcataattgaaaataaaat

SEQ ID NO: 737443 - DNA, 25 bp, Artificial sequence
  Synthetic oligonucleotide
tactaagttttcttttacggattca

SEQ ID NO: 737444 - DNA, 25 bp, Artificial sequence
  Synthetic oligonucleotide
tactaagttttcatttacggattca

SEQ ID NO: 737445 - DNA, 25 bp, Artificial sequence
  Synthetic oligonucleotide
ttttcgtcaaatgtagtgtacctaa

SEQ ID NO: 737446 - DNA, 25 bp, Artificial sequence
  Synthetic oligonucleotide
ttttcgtcaaatctagtgtacctaa

SEQ ID NO: 737447 - DNA, 25 bp, Artificial sequence
  Synthetic oligonucleotide
gatcaagtatacagcgacttcaaag

SEQ ID NO: 737448 - DNA, 25 bp, Artificial sequence
  Synthetic oligonucleotide
gatcaagtatactgcgacttcaaag

SEQ ID NO: 737449 - DNA, 25 bp, Artificial sequence
  Synthetic oligonucleotide
caagaatttgtaatgacataagtta

SEQ ID NO: 737450 - DNA, 25 bp, Artificial sequence
  Synthetic oligonucleotide
gagatttcatcgtgttgattatgaa

SEQ ID NO: 737451 - DNA, 25 bp, Artificial sequence
  Synthetic oligonucleotide
gatacacgtgtcaatcagctgcaca

SEQ ID NO: 737452 - DNA, 25 bp, Artificial sequence
  Synthetic oligonucleotide
gttaatgattattcgaaatatcgag

SEQ ID NO: 737453 - DNA, 25 bp, Artificial sequence
  Synthetic oligonucleotide
gcacctctatcattcaattatgtag

SEQ ID NO: 737454 - DNA, 25 bp, Artificial sequence
  Synthetic oligonucleotide
gcacctctatcaatcaattatgtag

SEQ ID NO: 737455 - DNA, 25 bp, Artificial sequence
  Synthetic oligonucleotide
tgaactttgctaattataatggcca

SEQ ID NO: 737456 - DNA, 25 bp, Artificial sequence
  Synthetic oligonucleotide
tgaactttgctatttataatggcca

SEQ ID NO: 737457 - DNA, 25 bp, Artificial sequence
  Synthetic oligonucleotide
taaacgtgatgggagaattgtgatg

SEQ ID NO: 737458 - DNA, 25 bp, Artificial sequence
  Synthetic oligonucleotide
cgctctaaacatcctaattaaaaaa

SEQ ID NO: 737459 - DNA, 25 bp, Artificial sequence
  Synthetic oligonucleotide
gatacacgtgtctatcagctgcaca

SEQ ID NO: 737460 - DNA, 25 bp, Artificial sequence
  Synthetic oligonucleotide
ttattaaatcttatttgttgttgac

SEQ ID NO: 737461 - DNA, 25 bp, Artificial sequence
  Synthetic oligonucleotide
ggacggtattacttatatagtacac

SEQ ID NO: 737462 - DNA, 25 bp, Artificial sequence
  Synthetic oligonucleotide
ggacggtattacatatatagtacac

SEQ ID NO: 737463 - DNA, 25 bp, Artificial sequence
  Synthetic oligonucleotide
gctgacatttcatctacaacgaaga

SEQ ID NO: 737464 - DNA, 25 bp, Artificial sequence
  Synthetic oligonucleotide
gctgacatttcaactacaacgaaga

SEQ ID NO: 737465 - DNA, 25 bp, Artificial sequence
  Synthetic oligonucleotide
aacgattttctcttgtctactacag

SEQ ID NO: 737466 - DNA, 25 bp, Artificial sequence
  Synthetic oligonucleotide
aacgattttctcatgtctactacag

SEQ ID NO: 737467 - DNA, 25 bp, Artificial sequence
  Synthetic oligonucleotide
cgctctaaacatgctaattaaaaaa

SEQ ID NO: 737468 - DNA, 25 bp, Artificial sequence
  Synthetic oligonucleotide
taaacgtgatggcagaattgtgatg

SEQ ID NO: 737469 - DNA, 25 bp, Artificial sequence
  Synthetic oligonucleotide
tcaagtatagtttgaaaaagactgt

SEQ ID NO: 737470 - DNA, 25 bp, Artificial sequence
  Synthetic oligonucleotide
tgggcggcgatagatccatcggcaa

SEQ ID NO: 737471 - DNA, 25 bp, Artificial sequence
  Synthetic oligonucleotide
taatccaagtctagcctctggcctt

SEQ ID NO: 737472 - DNA, 25 bp, Artificial sequence
  Synthetic oligonucleotide
actatgagacatttatgagactgca

SEQ ID NO: 737473 - DNA, 25 bp, Artificial sequence
  Synthetic oligonucleotide
actatgagacatatatgagactgca

SEQ ID NO: 737474 - DNA, 25 bp, Artificial sequence
  Synthetic oligonucleotide
ttatatatggctaatagagcgatag

SEQ ID NO: 737475 - DNA, 25 bp, Artificial sequence
  Synthetic oligonucleotide
tattgcattcatgctatgtactgca

SEQ ID NO: 737476 - DNA, 25 bp, Artificial sequence
  Synthetic oligonucleotide
ggtttcgtgtatatattcccgcttg

SEQ ID NO: 737477 - DNA, 25 bp, Artificial sequence
  Synthetic oligonucleotide
gttaatgattatacgaaatatcgag

SEQ ID NO: 737478 - DNA, 25 bp, Artificial sequence
  Synthetic oligonucleotide
tcaagtatagttagaaaaagactgt

SEQ ID NO: 737479 - DNA, 25 bp, Artificial sequence
  Synthetic oligonucleotide
ttattaaatcttttttgttgttgac

SEQ ID NO: 737480 - DNA, 25 bp, Artificial sequence
  Synthetic oligonucleotide
tatggttcgtatacaaaattatgca

SEQ ID NO: 737481 - DNA, 25 bp, Artificial sequence
  Synthetic oligonucleotide
tatggttcgtattcaaaattatgca

SEQ ID NO: 737482 - DNA, 25 bp, Artificial sequence
  Synthetic oligonucleotide
tggcattcacgtaaaaatcttcctg

SEQ ID NO: 737483 - DNA, 25 bp, Artificial sequence
  Synthetic oligonucleotide
tggcattcacgttaaaatcttcctg

SEQ ID NO: 737484 - DNA, 25 bp, Artificial sequence
  Synthetic oligonucleotide
tataaaacgtatttttggcgtacga

SEQ ID NO: 737485 - DNA, 25 bp, Artificial sequence
  Synthetic oligonucleotide
tataaaacgtatatttggcgtacga

SEQ ID NO: 737486 - DNA, 25 bp, Artificial sequence
  Synthetic oligonucleotide
tattgcattcatcctatgtactgca

SEQ ID NO: 737487 - DNA, 25 bp, Artificial sequence
  Synthetic oligonucleotide
ggtttcgtgtatttattcccgcttg

SEQ ID NO: 737488 - DNA, 25 bp, Artificial sequence
  Synthetic oligonucleotide
ggtgccacctccgtgctgtgcagga

SEQ ID NO: 737489 - DNA, 25 bp, Artificial sequence
  Synthetic oligonucleotide
taattgtgttatgacccaaaagaga

SEQ ID NO: 737490 - DNA, 25 bp, Artificial sequence
  Synthetic oligonucleotide
cacaatggctttcgctttgaggttc

SEQ ID NO: 737491 - DNA, 25 bp, Artificial sequence
  Synthetic oligonucleotide
cacaatggctttggctttgaggttc

SEQ ID NO: 737492 - DNA, 25 bp, Artificial sequence
  Synthetic oligonucleotide
tgttttgacagtcttcatcgttgca

SEQ ID NO: 737493 - DNA, 25 bp, Artificial sequence
  Synthetic oligonucleotide
tgttttgacagtgttcatcgttgca

SEQ ID NO: 737494 - DNA, 25 bp, Artificial sequence
  Synthetic oligonucleotide
gcagcaataacatgtggcacagtgg

SEQ ID NO: 737495 - DNA, 25 bp, Artificial sequence
  Synthetic oligonucleotide
gcagcaataacaagtggcacagtgg

SEQ ID NO: 737496 - DNA, 25 bp, Artificial sequence
  Synthetic oligonucleotide
taattgtgttatcacccaaaagaga

SEQ ID NO: 737497 - DNA, 25 bp, Artificial sequence
  Synthetic oligonucleotide
tgagtccatgtcaaggctacctatc

SEQ ID NO: 737498 - DNA, 25 bp, Artificial sequence
  Synthetic oligonucleotide
tgaacggtatgggtcaaaccacacc

SEQ ID NO: 737499 - DNA, 25 bp, Artificial sequence
  Synthetic oligonucleotide
ggtgccacctccctgctgtgcagga

SEQ ID NO: 737500 - DNA, 25 bp, Artificial sequence
  Synthetic oligonucleotide
tgaacggtatggctcaaaccacacc

SEQ ID NO: 737501 - DNA, 25 bp, Artificial sequence
  Synthetic oligonucleotide
taatccaagtcttgcctctggcctt

SEQ ID NO: 737502 - DNA, 25 bp, Artificial sequence
  Synthetic oligonucleotide
gcatgcagatgcttacagtccgctg

SEQ ID NO: 737503 - DNA, 25 bp, Artificial sequence
  Synthetic oligonucleotide
taactgcagataaatgaatatatat

SEQ ID NO: 737504 - DNA, 25 bp, Artificial sequence
  Synthetic oligonucleotide
ttatatatggcttatagagcgatag

SEQ ID NO: 737505 - DNA, 25 bp, Artificial sequence
  Synthetic oligonucleotide
gcatgcagatgcatacagtccgctg

SEQ ID NO: 737506 - DNA, 25 bp, Artificial sequence
  Synthetic oligonucleotide
tgagtccatgtctaggctacctatc

SEQ ID NO: 737507 - DNA, 25 bp, Artificial sequence
  Synthetic oligonucleotide
tacatatgactggagaaactaatta

SEQ ID NO: 737508 - DNA, 25 bp, Artificial sequence
  Synthetic oligonucleotide
cagtatagctgtttatatattgacg

SEQ ID NO: 737509 - DNA, 25 bp, Artificial sequence
  Synthetic oligonucleotide
tccaacaacaaaacacaagcgtaga

SEQ ID NO: 737510 - DNA, 25 bp, Artificial sequence
  Synthetic oligonucleotide
tacattctgaaaactgatactattg

SEQ ID NO: 737511 - DNA, 25 bp, Artificial sequence
  Synthetic oligonucleotide
cagtatagctgtatatatattgacg

SEQ ID NO: 737512 - DNA, 25 bp, Artificial sequence
  Synthetic oligonucleotide
tacattctgaaatctgatactattg

SEQ ID NO: 737513 - DNA, 25 bp, Artificial sequence
  Synthetic oligonucleotide
taactgcagatatatgaatatatat

SEQ ID NO: 737514 - DNA, 25 bp, Artificial sequence
  Synthetic oligonucleotide
tacatatgactgcagaaactaatta

SEQ ID NO: 737515 - DNA, 25 bp, Artificial sequence
  Synthetic oligonucleotide
gaaacataactacatatgactggag

SEQ ID NO: 737516 - DNA, 25 bp, Artificial sequence
  Synthetic oligonucleotide
gaaacataactagatatgactggag

SEQ ID NO: 737517 - DNA, 25 bp, Artificial sequence
  Synthetic oligonucleotide
tagtcatcatttttcccccatacga

SEQ ID NO: 737518 - DNA, 25 bp, Artificial sequence
  Synthetic oligonucleotide
ttcgttagtagatgaaactagaaag

SEQ ID NO: 737519 - DNA, 25 bp, Artificial sequence
  Synthetic oligonucleotide
tatataaacccaacatcatctccca

SEQ ID NO: 737520 - DNA, 25 bp, Artificial sequence
  Synthetic oligonucleotide
tagtcatcatttatcccccatacga

SEQ ID NO: 737521 - DNA, 25 bp, Artificial sequence
  Synthetic oligonucleotide
taaatgcaaaacgaactactaacaa

SEQ ID NO: 737522 - DNA, 25 bp, Artificial sequence
  Synthetic oligonucleotide
taaatgcaaaaccaactactaacaa

SEQ ID NO: 737523 - DNA, 25 bp, Artificial sequence
  Synthetic oligonucleotide
tccaacaacaaatcacaagcgtaga

SEQ ID NO: 737524 - DNA, 25 bp, Artificial sequence
  Synthetic oligonucleotide
ttcgttagtagaagaaactagaaag

SEQ ID NO: 737525 - DNA, 25 bp, Artificial sequence
  Synthetic oligonucleotide
tatataaacccatcatcatctccca

SEQ ID NO: 737526 - DNA, 25 bp, Artificial sequence
  Synthetic oligonucleotide
tctcgatcaactctgaaaaatatat

SEQ ID NO: 737527 - DNA, 25 bp, Artificial sequence
  Synthetic oligonucleotide
tctcgatcaactgtgaaaaatatat

SEQ ID NO: 737528 - DNA, 25 bp, Artificial sequence
  Synthetic oligonucleotide
cgtaaactctaaaacctaatatcag

SEQ ID NO: 737529 - DNA, 25 bp, Artificial sequence
  Synthetic oligonucleotide
taaccaagaattcataaacaaactg

SEQ ID NO: 737530 - DNA, 25 bp, Artificial sequence
  Synthetic oligonucleotide
taaccaagaattgataaacaaactg

SEQ ID NO: 737531 - DNA, 25 bp, Artificial sequence
  Synthetic oligonucleotide
gaactagcttcctttattgcaactt

SEQ ID NO: 737532 - DNA, 25 bp, Artificial sequence
  Synthetic oligonucleotide
gaactagcttccattattgcaactt

SEQ ID NO: 737533 - DNA, 25 bp, Artificial sequence
  Synthetic oligonucleotide
gaaacatgaagtaaatctacagcct

SEQ ID NO: 737534 - DNA, 25 bp, Artificial sequence
  Synthetic oligonucleotide
gaaacatgaagttaatctacagcct

SEQ ID NO: 737535 - DNA, 25 bp, Artificial sequence
  Synthetic oligonucleotide
gagtccggcttttggaaaagttcga

SEQ ID NO: 737536 - DNA, 25 bp, Artificial sequence
  Synthetic oligonucleotide
tgtttctgttaaatatagcaattcc

SEQ ID NO: 737537 - DNA, 25 bp, Artificial sequence
  Synthetic oligonucleotide
cgtaaactctaatacctaatatcag

SEQ ID NO: 737538 - DNA, 25 bp, Artificial sequence
  Synthetic oligonucleotide
cctaataattaataaatgagggcat

SEQ ID NO: 737539 - DNA, 25 bp, Artificial sequence
  Synthetic oligonucleotide
gagtccggctttaggaaaagttcga

SEQ ID NO: 737540 - DNA, 25 bp, Artificial sequence
  Synthetic oligonucleotide
taaaatggtgctgtaatggtaaaag

SEQ ID NO: 737541 - DNA, 25 bp, Artificial sequence
  Synthetic oligonucleotide
tgtttctgttaattatagcaattcc

SEQ ID NO: 737542 - DNA, 25 bp, Artificial sequence
  Synthetic oligonucleotide
cctaataattaaaaaatgagggcat

SEQ ID NO: 737543 - DNA, 25 bp, Artificial sequence
  Synthetic oligonucleotide
gcccttccactgactgcgacaggta

SEQ ID NO: 737544 - DNA, 25 bp, Artificial sequence
  Synthetic oligonucleotide
gcccttccactgtctgcgacaggta

SEQ ID NO: 737545 - DNA, 25 bp, Artificial sequence
  Synthetic oligonucleotide
cactctctctctatgtgattactga

SEQ ID NO: 737546 - DNA, 25 bp, Artificial sequence
  Synthetic oligonucleotide
cactaaaagagagatactatttgac

SEQ ID NO: 737547 - DNA, 25 bp, Artificial sequence
  Synthetic oligonucleotide
tttcttttttttacagtatccagtg

SEQ ID NO: 737548 - DNA, 25 bp, Artificial sequence
  Synthetic oligonucleotide
tttctttttttttcagtatccagtg

SEQ ID NO: 737549 - DNA, 25 bp, Artificial sequence
  Synthetic oligonucleotide
gctagttgctaattgatcagtgatg

SEQ ID NO: 737550 - DNA, 25 bp, Artificial sequence
  Synthetic oligonucleotide
aaatcttaaaggtagctactacaag

SEQ ID NO: 737551 - DNA, 25 bp, Artificial sequence
  Synthetic oligonucleotide
tattgaaaatgcgttagtaaacact

SEQ ID NO: 737552 - DNA, 25 bp, Artificial sequence
  Synthetic oligonucleotide
gctagttgctaaatgatcagtgatg

SEQ ID NO: 737553 - DNA, 25 bp, Artificial sequence
  Synthetic oligonucleotide
cactctctctctttgtgattactga

SEQ ID NO: 737554 - DNA, 25 bp, Artificial sequence
  Synthetic oligonucleotide
gaatgttctaatttcagcaggcact

SEQ ID NO: 737555 - DNA, 25 bp, Artificial sequence
  Synthetic oligonucleotide
gaatgttctaatatcagcaggcact

SEQ ID NO: 737556 - DNA, 25 bp, Artificial sequence
  Synthetic oligonucleotide
gaaacattctccatgcttccaccct

SEQ ID NO: 737557 - DNA, 25 bp, Artificial sequence
  Synthetic oligonucleotide
gaaacattctccttgcttccaccct

SEQ ID NO: 737558 - DNA, 25 bp, Artificial sequence
  Synthetic oligonucleotide
tattgaaaatgccttagtaaacact

SEQ ID NO: 737559 - DNA, 25 bp, Artificial sequence
  Synthetic oligonucleotide
aaatcttaaaggaagctactacaag

SEQ ID NO: 737560 - DNA, 25 bp, Artificial sequence
  Synthetic oligonucleotide
gggattgatgaaaatagagaaaccg

SEQ ID NO: 737561 - DNA, 25 bp, Artificial sequence
  Synthetic oligonucleotide
taacctaacaaacacacaatctgca

SEQ ID NO: 737562 - DNA, 25 bp, Artificial sequence
  Synthetic oligonucleotide
taacctaacaaagacacaatctgca

SEQ ID NO: 737563 - DNA, 25 bp, Artificial sequence
  Synthetic oligonucleotide
caaaaacatttcttttacgtcaaga

SEQ ID NO: 737564 - DNA, 25 bp, Artificial sequence
  Synthetic oligonucleotide
caaaaacatttcatttacgtcaaga

SEQ ID NO: 737565 - DNA, 25 bp, Artificial sequence
  Synthetic oligonucleotide
catgttcttgaatcaaaaagagtaa

SEQ ID NO: 737566 - DNA, 25 bp, Artificial sequence
  Synthetic oligonucleotide
catgttcttgaaacaaaaagagtaa

SEQ ID NO: 737567 - DNA, 25 bp, Artificial sequence
  Synthetic oligonucleotide
caatatagtttattttttatgcata

SEQ ID NO: 737568 - DNA, 25 bp, Artificial sequence
  Synthetic oligonucleotide
cacaaaaaaaaaacgaacatatcac

SEQ ID NO: 737569 - DNA, 25 bp, Artificial sequence
  Synthetic oligonucleotide
cactaaaagagacatactatttgac

SEQ ID NO: 737570 - DNA, 25 bp, Artificial sequence
  Synthetic oligonucleotide
gggattgatgaatatagagaaaccg

SEQ ID NO: 737571 - DNA, 25 bp, Artificial sequence
  Synthetic oligonucleotide
gtcggagtttaggacttttatgggc

SEQ ID NO: 737572 - DNA, 25 bp, Artificial sequence
  Synthetic oligonucleotide
ccttctaaatgtggtgtcgatctcc

SEQ ID NO: 737573 - DNA, 25 bp, Artificial sequence
  Synthetic oligonucleotide
ggcattaaatcaaacactactgaat

SEQ ID NO: 737574 - DNA, 25 bp, Artificial sequence
  Synthetic oligonucleotide
gtcggagtttagcacttttatgggc

SEQ ID NO: 737575 - DNA, 25 bp, Artificial sequence
  Synthetic oligonucleotide
gaagtcttctctttttatccaatcc

SEQ ID NO: 737576 - DNA, 25 bp, Artificial sequence
  Synthetic oligonucleotide
cacaaaaaaaaatcgaacatatcac

SEQ ID NO: 737577 - DNA, 25 bp, Artificial sequence
  Synthetic oligonucleotide
ccaaatgacctaaattgattgtttg

SEQ ID NO: 737578 - DNA, 25 bp, Artificial sequence
  Synthetic oligonucleotide
tggttaattcgatcaaataaaactt

SEQ ID NO: 737579 - DNA, 25 bp, Artificial sequence
  Synthetic oligonucleotide
tggttaattcgaacaaataaaactt

SEQ ID NO: 737580 - DNA, 25 bp, Artificial sequence
  Synthetic oligonucleotide
tgctctgaaaaacgcttaagaccaa

SEQ ID NO: 737581 - DNA, 25 bp, Artificial sequence
  Synthetic oligonucleotide
tgctctgaaaaaggcttaagaccaa

SEQ ID NO: 737582 - DNA, 25 bp, Artificial sequence
  Synthetic oligonucleotide
gatacttttatcagttcaaattgcc

SEQ ID NO: 737583 - DNA, 25 bp, Artificial sequence
  Synthetic oligonucleotide
gatacttttatctgttcaaattgcc

SEQ ID NO: 737584 - DNA, 25 bp, Artificial sequence
  Synthetic oligonucleotide
gcatttgtagctacgttcttagagt

SEQ ID NO: 737585 - DNA, 25 bp, Artificial sequence
  Synthetic oligonucleotide
caagacttatatatcactgttatta

SEQ ID NO: 737586 - DNA, 25 bp, Artificial sequence
  Synthetic oligonucleotide
gcatttgtagcttcgttcttagagt

SEQ ID NO: 737587 - DNA, 25 bp, Artificial sequence
  Synthetic oligonucleotide
ccaaatgacctatattgattgtttg

SEQ ID NO: 737588 - DNA, 25 bp, Artificial sequence
  Synthetic oligonucleotide
tatctgaaaatggaatggaatattc

SEQ ID NO: 737589 - DNA, 25 bp, Artificial sequence
  Synthetic oligonucleotide
tatctgaaaatgcaatggaatattc

SEQ ID NO: 737590 - DNA, 25 bp, Artificial sequence
  Synthetic oligonucleotide
acaaataagattaatttggttaaca

SEQ ID NO: 737591 - DNA, 25 bp, Artificial sequence
  Synthetic oligonucleotide
acaaataagatttatttggttaaca

SEQ ID NO: 737592 - DNA, 25 bp, Artificial sequence
  Synthetic oligonucleotide
caatatagtttaatttttatgcata

SEQ ID NO: 737593 - DNA, 25 bp, Artificial sequence
  Synthetic oligonucleotide
taaaatggtgctctaatggtaaaag

SEQ ID NO: 737594 - DNA, 25 bp, Artificial sequence
  Synthetic oligonucleotide
caagacttatatttcactgttatta

SEQ ID NO: 737595 - DNA, 25 bp, Artificial sequence
  Synthetic oligonucleotide
tacacacatgggataaacactatcc

SEQ ID NO: 737596 - DNA, 25 bp, Artificial sequence
  Synthetic oligonucleotide
tgtaacaacaaatcgtaccaaccgc

SEQ ID NO: 737597 - DNA, 25 bp, Artificial sequence
  Synthetic oligonucleotide
tgtaacaacaaaacgtaccaaccgc

SEQ ID NO: 737598 - DNA, 25 bp, Artificial sequence
  Synthetic oligonucleotide
tctttatctagaccgtcaatgcact

SEQ ID NO: 737599 - DNA, 25 bp, Artificial sequence
  Synthetic oligonucleotide
tctttatctagagcgtcaatgcact

SEQ ID NO: 737600 - DNA, 25 bp, Artificial sequence
  Synthetic oligonucleotide
tacaactcaatatccatcgcctaaa

SEQ ID NO: 737601 - DNA, 25 bp, Artificial sequence
  Synthetic oligonucleotide
tacaactcaataaccatcgcctaaa

SEQ ID NO: 737602 - DNA, 25 bp, Artificial sequence
  Synthetic oligonucleotide
tcaaaccagtaacaaattaaatact

SEQ ID NO: 737603 - DNA, 25 bp, Artificial sequence
  Synthetic oligonucleotide
tccttttgtcgaggttgatattgac

SEQ ID NO: 737604 - DNA, 25 bp, Artificial sequence
  Synthetic oligonucleotide
gatcaatttcacaccacagctctta

SEQ ID NO: 737605 - DNA, 25 bp, Artificial sequence
  Synthetic oligonucleotide
tacacacatgggttaaacactatcc

SEQ ID NO: 737606 - DNA, 25 bp, Artificial sequence
  Synthetic oligonucleotide
tgtagatgagaagtgaaatcctttt

SEQ ID NO: 737607 - DNA, 25 bp, Artificial sequence
  Synthetic oligonucleotide
tgtagatgagaactgaaatcctttt

SEQ ID NO: 737608 - DNA, 25 bp, Artificial sequence
  Synthetic oligonucleotide
tcaaagcagtttaaaaactttgaat

SEQ ID NO: 737609 - DNA, 25 bp, Artificial sequence
  Synthetic oligonucleotide
tcaaagcagttttaaaactttgaat

SEQ ID NO: 737610 - DNA, 25 bp, Artificial sequence
  Synthetic oligonucleotide
tcaaaccagtaagaaattaaatact

SEQ ID NO: 737611 - DNA, 25 bp, Artificial sequence
  Synthetic oligonucleotide
tccttttgtcgacgttgatattgac

SEQ ID NO: 737612 - DNA, 25 bp, Artificial sequence
  Synthetic oligonucleotide
taataatacaagctacagaatttgg

SEQ ID NO: 737613 - DNA, 25 bp, Artificial sequence
  Synthetic oligonucleotide
gatcaatttcactccacagctctta

SEQ ID NO: 737614 - DNA, 25 bp, Artificial sequence
  Synthetic oligonucleotide
gaagtcttctctatttatccaatcc

SEQ ID NO: 737615 - DNA, 25 bp, Artificial sequence
  Synthetic oligonucleotide
taaataccatgtgaatgtgtatagt

SEQ ID NO: 737616 - DNA, 25 bp, Artificial sequence
  Synthetic oligonucleotide
taaataccatgtcaatgtgtatagt

SEQ ID NO: 737617 - DNA, 25 bp, Artificial sequence
  Synthetic oligonucleotide
caattgatctcgaattttattgact

SEQ ID NO: 737618 - DNA, 25 bp, Artificial sequence
  Synthetic oligonucleotide
caattgatctcgtattttattgact

SEQ ID NO: 737619 - DNA, 25 bp, Artificial sequence
  Synthetic oligonucleotide
aagatgctccttcatatttgtgcta

SEQ ID NO: 737620 - DNA, 25 bp, Artificial sequence
  Synthetic oligonucleotide
gagttgtaaaagttggatacagccc

SEQ ID NO: 737621 - DNA, 25 bp, Artificial sequence
  Synthetic oligonucleotide
aagatgctccttgatatttgtgcta

SEQ ID NO: 737622 - DNA, 25 bp, Artificial sequence
  Synthetic oligonucleotide
taataatacaaggtacagaatttgg

SEQ ID NO: 737623 - DNA, 25 bp, Artificial sequence
  Synthetic oligonucleotide
gaatacatgtttgttctgaatcagg

SEQ ID NO: 737624 - DNA, 25 bp, Artificial sequence
  Synthetic oligonucleotide
gaatacatgtttcttctgaatcagg

SEQ ID NO: 737625 - DNA, 25 bp, Artificial sequence
  Synthetic oligonucleotide
tcggctaaaccgtacaaaattggga

SEQ ID NO: 737626 - DNA, 25 bp, Artificial sequence
  Synthetic oligonucleotide
tcggctaaaccgaacaaaattggga

SEQ ID NO: 737627 - DNA, 25 bp, Artificial sequence
  Synthetic oligonucleotide
tacttgatggaatccaaccaaaacg

SEQ ID NO: 737628 - DNA, 25 bp, Artificial sequence
  Synthetic oligonucleotide
tcctatcttaatgtattagtctttt

SEQ ID NO: 737629 - DNA, 25 bp, Artificial sequence
  Synthetic oligonucleotide
gagttgtaaaagatggatacagccc

SEQ ID NO: 737630 - DNA, 25 bp, Artificial sequence
  Synthetic oligonucleotide
ggtcccaaccctctgctgcaacggt

SEQ ID NO: 737631 - DNA, 25 bp, Artificial sequence
  Synthetic oligonucleotide
aaaaaaaacagaaagtaacatgaga

SEQ ID NO: 737632 - DNA, 25 bp, Artificial sequence
  Synthetic oligonucleotide
tattagccgtgtccctggttcttgc

SEQ ID NO: 737633 - DNA, 25 bp, Artificial sequence
  Synthetic oligonucleotide
tattagccgtgtgcctggttcttgc

SEQ ID NO: 737634 - DNA, 25 bp, Artificial sequence
  Synthetic oligonucleotide
ggtgaagcagccgtgtcttgcaaca

SEQ ID NO: 737635 - DNA, 25 bp, Artificial sequence
  Synthetic oligonucleotide
ggtgaagcagccctgtcttgcaaca

SEQ ID NO: 737636 - DNA, 25 bp, Artificial sequence
  Synthetic oligonucleotide
gatctttacccttgcttatcctacg

SEQ ID NO: 737637 - DNA, 25 bp, Artificial sequence
  Synthetic oligonucleotide
ggcattaaatcatacactactgaat

SEQ ID NO: 737638 - DNA, 25 bp, Artificial sequence
  Synthetic oligonucleotide
ggtcccaaccctgtgctgcaacggt

SEQ ID NO: 737639 - DNA, 25 bp, Artificial sequence
  Synthetic oligonucleotide
taaataacctctgtattttctaacc

SEQ ID NO: 737640 - DNA, 25 bp, Artificial sequence
  Synthetic oligonucleotide
caagagtcaggcacaaacttctgtg

SEQ ID NO: 737641 - DNA, 25 bp, Artificial sequence
  Synthetic oligonucleotide
caagagtcaggctcaaacttctgtg

SEQ ID NO: 737642 - DNA, 25 bp, Artificial sequence
  Synthetic oligonucleotide
gggtctgtcgttgcatcaaatctgc

SEQ ID NO: 737643 - DNA, 25 bp, Artificial sequence
  Synthetic oligonucleotide
gggtctgtcgttccatcaaatctgc

SEQ ID NO: 737644 - DNA, 25 bp, Artificial sequence
  Synthetic oligonucleotide
ctctctcctagatccatccaaaatg

SEQ ID NO: 737645 - DNA, 25 bp, Artificial sequence
  Synthetic oligonucleotide
ctctctcctagaaccatccaaaatg

SEQ ID NO: 737646 - DNA, 25 bp, Artificial sequence
  Synthetic oligonucleotide
gatctttaccctagcttatcctacg

SEQ ID NO: 737647 - DNA, 25 bp, Artificial sequence
  Synthetic oligonucleotide
tattgttagatagaatgcagttgaa

SEQ ID NO: 737648 - DNA, 25 bp, Artificial sequence
  Synthetic oligonucleotide
tcctatcttaatctattagtctttt

SEQ ID NO: 737649 - DNA, 25 bp, Artificial sequence
  Synthetic oligonucleotide
taacaactcttcacattgtagttgg

SEQ ID NO: 737650 - DNA, 25 bp, Artificial sequence
  Synthetic oligonucleotide
taacaactcttctcattgtagttgg

SEQ ID NO: 737651 - DNA, 25 bp, Artificial sequence
  Synthetic oligonucleotide
tagtaggccttttttattgattaag

SEQ ID NO: 737652 - DNA, 25 bp, Artificial sequence
  Synthetic oligonucleotide
tagtaggcctttattattgattaag

SEQ ID NO: 737653 - DNA, 25 bp, Artificial sequence
  Synthetic oligonucleotide
tggatagttaaacaagaaaaaatgt

SEQ ID NO: 737654 - DNA, 25 bp, Artificial sequence
  Synthetic oligonucleotide
aaaaaaaacagatagtaacatgaga

SEQ ID NO: 737655 - DNA, 25 bp, Artificial sequence
  Synthetic oligonucleotide
tattgttagatacaatgcagttgaa

SEQ ID NO: 737656 - DNA, 25 bp, Artificial sequence
  Synthetic oligonucleotide
taaataacctctctattttctaacc

SEQ ID NO: 737657 - DNA, 25 bp, Artificial sequence
  Synthetic oligonucleotide
gatcttaattggctgaaggtaaaca

SEQ ID NO: 737658 - DNA, 25 bp, Artificial sequence
  Synthetic oligonucleotide
gatcttaattgggtgaaggtaaaca

SEQ ID NO: 737659 - DNA, 25 bp, Artificial sequence
  Synthetic oligonucleotide
caactaactaactgtaacactcgtg

SEQ ID NO: 737660 - DNA, 25 bp, Artificial sequence
  Synthetic oligonucleotide
caactaactaacagtaacactcgtg

SEQ ID NO: 737661 - DNA, 25 bp, Artificial sequence
  Synthetic oligonucleotide
actcttcctcaagtaccaatctcaa

SEQ ID NO: 737662 - DNA, 25 bp, Artificial sequence
  Synthetic oligonucleotide
actcttcctcaactaccaatctcaa

SEQ ID NO: 737663 - DNA, 25 bp, Artificial sequence
  Synthetic oligonucleotide
ccttctaaatgtcgtgtcgatctcc

SEQ ID NO: 737664 - DNA, 25 bp, Artificial sequence
  Synthetic oligonucleotide
tggatagttaaagaagaaaaaatgt

SEQ ID NO: 737665 - DNA, 25 bp, Artificial sequence
  Synthetic oligonucleotide
tacttgatggaaaccaaccaaaacg

SEQ ID NO: 737666 - DNA, 25 bp, Artificial sequence
  Synthetic oligonucleotide
tttgatgtggtaaatataagctctc

SEQ ID NO: 737667 - DNA, 25 bp, Artificial sequence
  Synthetic oligonucleotide
tgcttatacctgaaagaacccttgc

SEQ ID NO: 737668 - DNA, 25 bp, Artificial sequence
  Synthetic oligonucleotide
gctatgggcaacactcttttatgga

SEQ ID NO: 737669 - DNA, 25 bp, Artificial sequence
  Synthetic oligonucleotide
gctatgggcaactctcttttatgga

SEQ ID NO: 737670 - DNA, 25 bp, Artificial sequence
  Synthetic oligonucleotide
tgatattcattataccatgacgcag

SEQ ID NO: 737671 - DNA, 25 bp, Artificial sequence
  Synthetic oligonucleotide
tgatattcattaaaccatgacgcag

SEQ ID NO: 737672 - DNA, 25 bp, Artificial sequence
  Synthetic oligonucleotide
tctgttgtcctatttggtagtagaa

SEQ ID NO: 737673 - DNA, 25 bp, Artificial sequence
  Synthetic oligonucleotide
tttcagcttaaagtatattcacccg

SEQ ID NO: 737674 - DNA, 25 bp, Artificial sequence
  Synthetic oligonucleotide
ttgtcacaagtatatgagtttatcg

SEQ ID NO: 737675 - DNA, 25 bp, Artificial sequence
  Synthetic oligonucleotide
tttgatgtggtatatataagctctc

SEQ ID NO: 737676 - DNA, 25 bp, Artificial sequence
  Synthetic oligonucleotide
gaaacgggcttaagatccctcgagc

SEQ ID NO: 737677 - DNA, 25 bp, Artificial sequence
  Synthetic oligonucleotide
gaaacgggcttatgatccctcgagc

SEQ ID NO: 737678 - DNA, 25 bp, Artificial sequence
  Synthetic oligonucleotide
ggcttatcgtcaatcacaatgttgc

SEQ ID NO: 737679 - DNA, 25 bp, Artificial sequence
  Synthetic oligonucleotide
ggcttatcgtcattcacaatgttgc

SEQ ID NO: 737680 - DNA, 25 bp, Artificial sequence
  Synthetic oligonucleotide
tttcagcttaaactatattcacccg

SEQ ID NO: 737681 - DNA, 25 bp, Artificial sequence
  Synthetic oligonucleotide
ttgtcacaagtaaatgagtttatcg

SEQ ID NO: 737682 - DNA, 25 bp, Artificial sequence
  Synthetic oligonucleotide
tgctctttccctattggatatctga

SEQ ID NO: 737683 - DNA, 25 bp, Artificial sequence
  Synthetic oligonucleotide
ttctccacagggtaaattgcaccag

SEQ ID NO: 737684 - DNA, 25 bp, Artificial sequence
  Synthetic oligonucleotide
ttctccacagggaaaattgcaccag

SEQ ID NO: 737685 - DNA, 25 bp, Artificial sequence
  Synthetic oligonucleotide
ttcgtggcagctacaattggtttga

SEQ ID NO: 737686 - DNA, 25 bp, Artificial sequence
  Synthetic oligonucleotide
ttcgtggcagcttcaattggtttga

SEQ ID NO: 737687 - DNA, 25 bp, Artificial sequence
  Synthetic oligonucleotide
ggttggttacttcacagatactctc

SEQ ID NO: 737688 - DNA, 25 bp, Artificial sequence
  Synthetic oligonucleotide
ggttggttacttgacagatactctc

SEQ ID NO: 737689 - DNA, 25 bp, Artificial sequence
  Synthetic oligonucleotide
catcgttccatttttgttttccacc

SEQ ID NO: 737690 - DNA, 25 bp, Artificial sequence
  Synthetic oligonucleotide
catcgttccattattgttttccacc

SEQ ID NO: 737691 - DNA, 25 bp, Artificial sequence
  Synthetic oligonucleotide
tgtgagatgttcataaatcactctc

SEQ ID NO: 737692 - DNA, 25 bp, Artificial sequence
  Synthetic oligonucleotide
tgtgagatgttcttaaatcactctc

SEQ ID NO: 737693 - DNA, 25 bp, Artificial sequence
  Synthetic oligonucleotide
cgtttcttcccccatttgtatgaaa

SEQ ID NO: 737694 - DNA, 25 bp, Artificial sequence
  Synthetic oligonucleotide
cgtttcttccccgatttgtatgaaa

SEQ ID NO: 737695 - DNA, 25 bp, Artificial sequence
  Synthetic oligonucleotide
tgcttatacctgtaagaacccttgc

SEQ ID NO: 737696 - DNA, 25 bp, Artificial sequence
  Synthetic oligonucleotide
gatgtgtagttgattatatggataa

SEQ ID NO: 737697 - DNA, 25 bp, Artificial sequence
  Synthetic oligonucleotide
ggagattatctcgaaacctttttaa

SEQ ID NO: 737698 - DNA, 25 bp, Artificial sequence
  Synthetic oligonucleotide
tattagcttgggaaatattgtaacc

SEQ ID NO: 737699 - DNA, 25 bp, Artificial sequence
  Synthetic oligonucleotide
tattagcttgggtaatattgtaacc

SEQ ID NO: 737700 - DNA, 25 bp, Artificial sequence
  Synthetic oligonucleotide
gctaagtgttggttgccgaatctct

SEQ ID NO: 737701 - DNA, 25 bp, Artificial sequence
  Synthetic oligonucleotide
gctaagtgttggatgccgaatctct

SEQ ID NO: 737702 - DNA, 25 bp, Artificial sequence
  Synthetic oligonucleotide
caatttcgcttctgtcctcgtgttg

SEQ ID NO: 737703 - DNA, 25 bp, Artificial sequence
  Synthetic oligonucleotide
caatttcgcttcagtcctcgtgttg

SEQ ID NO: 737704 - DNA, 25 bp, Artificial sequence
  Synthetic oligonucleotide
tatgaacaaaaaaaactatgtcagg

SEQ ID NO: 737705 - DNA, 25 bp, Artificial sequence
  Synthetic oligonucleotide
tatgaacaaaaataactatgtcagg

SEQ ID NO: 737706 - DNA, 25 bp, Artificial sequence
  Synthetic oligonucleotide
tagaaaaaaaaattggtggccttga

SEQ ID NO: 737707 - DNA, 25 bp, Artificial sequence
  Synthetic oligonucleotide
tagaaaaaaaaaatggtggccttga

SEQ ID NO: 737708 - DNA, 25 bp, Artificial sequence
  Synthetic oligonucleotide
ccaagtctgtattaggattctctga

SEQ ID NO: 737709 - DNA, 25 bp, Artificial sequence
  Synthetic oligonucleotide
ccaagtctgtataaggattctctga

SEQ ID NO: 737710 - DNA, 25 bp, Artificial sequence
  Synthetic oligonucleotide
tcagtggacaaattttctaaacccg

SEQ ID NO: 737711 - DNA, 25 bp, Artificial sequence
  Synthetic oligonucleotide
tagggtctttatctggatggacagc

SEQ ID NO: 737712 - DNA, 25 bp, Artificial sequence
  Synthetic oligonucleotide
tcgccgtttagaactttgaaagaac

SEQ ID NO: 737713 - DNA, 25 bp, Artificial sequence
  Synthetic oligonucleotide
tgctctttcccttttggatatctga

SEQ ID NO: 737714 - DNA, 25 bp, Artificial sequence
  Synthetic oligonucleotide
tcattttttctctcgttctttgaac

SEQ ID NO: 737715 - DNA, 25 bp, Artificial sequence
  Synthetic oligonucleotide
tcattttttctcacgttctttgaac

SEQ ID NO: 737716 - DNA, 25 bp, Artificial sequence
  Synthetic oligonucleotide
tcatgtggatgcgagtttcccaaat

SEQ ID NO: 737717 - DNA, 25 bp, Artificial sequence
  Synthetic oligonucleotide
tcctggtttcgtagatccttcaaaa

SEQ ID NO: 737718 - DNA, 25 bp, Artificial sequence
  Synthetic oligonucleotide
tagggtctttatgtggatggacagc

SEQ ID NO: 737719 - DNA, 25 bp, Artificial sequence
  Synthetic oligonucleotide
tcctggtttcgttgatccttcaaaa

SEQ ID NO: 737720 - DNA, 25 bp, Artificial sequence
  Synthetic oligonucleotide
gaactgggaaacattcagagaaagg

SEQ ID NO: 737721 - DNA, 25 bp, Artificial sequence
  Synthetic oligonucleotide
gaactgggaaactttcagagaaagg

SEQ ID NO: 737722 - DNA, 25 bp, Artificial sequence
  Synthetic oligonucleotide
ttctcttaactagctactggtaaga

SEQ ID NO: 737723 - DNA, 25 bp, Artificial sequence
  Synthetic oligonucleotide
ttctcttaactacctactggtaaga

SEQ ID NO: 737724 - DNA, 25 bp, Artificial sequence
  Synthetic oligonucleotide
gatgtgtagttgtttatatggataa

SEQ ID NO: 737725 - DNA, 25 bp, Artificial sequence
  Synthetic oligonucleotide
tcagtggacaaaatttctaaacccg

SEQ ID NO: 737726 - DNA, 25 bp, Artificial sequence
  Synthetic oligonucleotide
tcatgtggatgccagtttcccaaat

SEQ ID NO: 737727 - DNA, 25 bp, Artificial sequence
  Synthetic oligonucleotide
tttaaacaacccatctcttctctcg

SEQ ID NO: 737728 - DNA, 25 bp, Artificial sequence
  Synthetic oligonucleotide
ctttgtggagagttgcagtggctta

SEQ ID NO: 737729 - DNA, 25 bp, Artificial sequence
  Synthetic oligonucleotide
caagcagcaatgtctagattcccgt

SEQ ID NO: 737730 - DNA, 25 bp, Artificial sequence
  Synthetic oligonucleotide
caagcagcaatgactagattcccgt

SEQ ID NO: 737731 - DNA, 25 bp, Artificial sequence
  Synthetic oligonucleotide
tgcatctccggcgaccggggttgat

SEQ ID NO: 737732 - DNA, 25 bp, Artificial sequence
  Synthetic oligonucleotide
tgcatctccggccaccggggttgat

SEQ ID NO: 737733 - DNA, 25 bp, Artificial sequence
  Synthetic oligonucleotide
ttaatcctccgcctcagcagaatcc

SEQ ID NO: 737734 - DNA, 25 bp, Artificial sequence
  Synthetic oligonucleotide
ttaatcctccgcgtcagcagaatcc

SEQ ID NO: 737735 - DNA, 25 bp, Artificial sequence
  Synthetic oligonucleotide
cctaatttgggacagcagacaccga

SEQ ID NO: 737736 - DNA, 25 bp, Artificial sequence
  Synthetic oligonucleotide
cctaatttgggagagcagacaccga

SEQ ID NO: 737737 - DNA, 25 bp, Artificial sequence
  Synthetic oligonucleotide
cagcagcagcagtatgtatcgagtc

SEQ ID NO: 737738 - DNA, 25 bp, Artificial sequence
  Synthetic oligonucleotide
cagcagcagcagaatgtatcgagtc

SEQ ID NO: 737739 - DNA, 25 bp, Artificial sequence
  Synthetic oligonucleotide
aaattgatgagggcattgaatcaca

SEQ ID NO: 737740 - DNA, 25 bp, Artificial sequence
  Synthetic oligonucleotide
aaattgatgaggccattgaatcaca

SEQ ID NO: 737741 - DNA, 25 bp, Artificial sequence
  Synthetic oligonucleotide
atgcttctattgcagcaattgcaaa

SEQ ID NO: 737742 - DNA, 25 bp, Artificial sequence
  Synthetic oligonucleotide
ccgcagcaattagtatagttttcta

SEQ ID NO: 737743 - DNA, 25 bp, Artificial sequence
  Synthetic oligonucleotide
tgagttgttatcaccttaggagtcg

SEQ ID NO: 737744 - DNA, 25 bp, Artificial sequence
  Synthetic oligonucleotide
tgagttgttatctccttaggagtcg

SEQ ID NO: 737745 - DNA, 25 bp, Artificial sequence
  Synthetic oligonucleotide
taattgaatttattgatctatcacg

SEQ ID NO: 737746 - DNA, 25 bp, Artificial sequence
  Synthetic oligonucleotide
taattgaatttaatgatctatcacg

SEQ ID NO: 737747 - DNA, 25 bp, Artificial sequence
  Synthetic oligonucleotide
taatgatatcaatcattgatctatc

SEQ ID NO: 737748 - DNA, 25 bp, Artificial sequence
  Synthetic oligonucleotide
aatgcgcttatctggacgcttggcg

SEQ ID NO: 737749 - DNA, 25 bp, Artificial sequence
  Synthetic oligonucleotide
ccgcagcaattactatagttttcta

SEQ ID NO: 737750 - DNA, 25 bp, Artificial sequence
  Synthetic oligonucleotide
aatgcgcttatcaggacgcttggcg

SEQ ID NO: 737751 - DNA, 25 bp, Artificial sequence
  Synthetic oligonucleotide
ctttatatacttttgatgaaattca

SEQ ID NO: 737752 - DNA, 25 bp, Artificial sequence
  Synthetic oligonucleotide
ctttatatacttatgatgaaattca

SEQ ID NO: 737753 - DNA, 25 bp, Artificial sequence
  Synthetic oligonucleotide
cgagaggtttgtagtatcaaatgca

SEQ ID NO: 737754 - DNA, 25 bp, Artificial sequence
  Synthetic oligonucleotide
cgagaggtttgttgtatcaaatgca

SEQ ID NO: 737755 - DNA, 25 bp, Artificial sequence
  Synthetic oligonucleotide
tttaaacaacccttctcttctctcg

SEQ ID NO: 737756 - DNA, 25 bp, Artificial sequence
  Synthetic oligonucleotide
caaaaatggaggacacgaagccacc

SEQ ID NO: 737757 - DNA, 25 bp, Artificial sequence
  Synthetic oligonucleotide
taatgatatcaaacattgatctatc

SEQ ID NO: 737758 - DNA, 25 bp, Artificial sequence
  Synthetic oligonucleotide
gaaacattctcgcttcagctttggc

SEQ ID NO: 737759 - DNA, 25 bp, Artificial sequence
  Synthetic oligonucleotide
gacattggttagtcatatcagtcac

SEQ ID NO: 737760 - DNA, 25 bp, Artificial sequence
  Synthetic oligonucleotide
tcgccgtttagatctttgaaagaac

SEQ ID NO: 737761 - DNA, 25 bp, Artificial sequence
  Synthetic oligonucleotide
ccgtaatgaatgaatgtacacgcca

SEQ ID NO: 737762 - DNA, 25 bp, Artificial sequence
  Synthetic oligonucleotide
ccgtaatgaatgtatgtacacgcca

SEQ ID NO: 737763 - DNA, 25 bp, Artificial sequence
  Synthetic oligonucleotide
tgttcaagcaagtccatagagatta

SEQ ID NO: 737764 - DNA, 25 bp, Artificial sequence
  Synthetic oligonucleotide
tgttcaagcaagaccatagagatta

SEQ ID NO: 737765 - DNA, 25 bp, Artificial sequence
  Synthetic oligonucleotide
tcattcttttttgctaagggttata

SEQ ID NO: 737766 - DNA, 25 bp, Artificial sequence
  Synthetic oligonucleotide
tcattcttttttcctaagggttata

SEQ ID NO: 737767 - DNA, 25 bp, Artificial sequence
  Synthetic oligonucleotide
ctactctgtaatttcatgtattttt

SEQ ID NO: 737768 - DNA, 25 bp, Artificial sequence
  Synthetic oligonucleotide
ctactctgtaatatcatgtattttt

SEQ ID NO: 737769 - DNA, 25 bp, Artificial sequence
  Synthetic oligonucleotide
gaatcatatagtaaaataatgtctg

SEQ ID NO: 737770 - DNA, 25 bp, Artificial sequence
  Synthetic oligonucleotide
gaatcatatagttaaataatgtctg

SEQ ID NO: 737771 - DNA, 25 bp, Artificial sequence
  Synthetic oligonucleotide
taacttttgataatgaacggtcaaa

SEQ ID NO: 737772 - DNA, 25 bp, Artificial sequence
  Synthetic oligonucleotide
atgcttctattggagcaattgcaaa

SEQ ID NO: 737773 - DNA, 25 bp, Artificial sequence
  Synthetic oligonucleotide
gcccaattagattggcccagataaa

SEQ ID NO: 737774 - DNA, 25 bp, Artificial sequence
  Synthetic oligonucleotide
caaaaatggaggtcacgaagccacc

SEQ ID NO: 737775 - DNA, 25 bp, Artificial sequence
  Synthetic oligonucleotide
tcccaaaatagaatccctaaaagag

SEQ ID NO: 737776 - DNA, 25 bp, Artificial sequence
  Synthetic oligonucleotide
tcccaaaatagattccctaaaagag

SEQ ID NO: 737777 - DNA, 25 bp, Artificial sequence
  Synthetic oligonucleotide
cacggcgaagaagatttccccgaaa

SEQ ID NO: 737778 - DNA, 25 bp, Artificial sequence
  Synthetic oligonucleotide
cacggcgaagaacatttccccgaaa

SEQ ID NO: 737779 - DNA, 25 bp, Artificial sequence
  Synthetic oligonucleotide
taacttttgatattgaacggtcaaa

SEQ ID NO: 737780 - DNA, 25 bp, Artificial sequence
  Synthetic oligonucleotide
tcttctctcacttagacaagacaac

SEQ ID NO: 737781 - DNA, 25 bp, Artificial sequence
  Synthetic oligonucleotide
gaaacattctcggttcagctttggc

SEQ ID NO: 737782 - DNA, 25 bp, Artificial sequence
  Synthetic oligonucleotide
gcccaattagataggcccagataaa

SEQ ID NO: 737783 - DNA, 25 bp, Artificial sequence
  Synthetic oligonucleotide
tagttggcttaaaatttgtggtctt

SEQ ID NO: 737784 - DNA, 25 bp, Artificial sequence
  Synthetic oligonucleotide
tagttggcttaatatttgtggtctt

SEQ ID NO: 737785 - DNA, 25 bp, Artificial sequence
  Synthetic oligonucleotide
tcagctttggctatcgttttcccgg

SEQ ID NO: 737786 - DNA, 25 bp, Artificial sequence
  Synthetic oligonucleotide
tcagctttggctttcgttttcccgg

SEQ ID NO: 737787 - DNA, 25 bp, Artificial sequence
  Synthetic oligonucleotide
ctttgtggagagatgcagtggctta

SEQ ID NO: 737788 - DNA, 25 bp, Artificial sequence
  Synthetic oligonucleotide
tcttctctcactaagacaagacaac

SEQ ID NO: 737789 - DNA, 25 bp, Artificial sequence
  Synthetic oligonucleotide
taggatcaatactaaagagcacatg

SEQ ID NO: 737790 - DNA, 25 bp, Artificial sequence
  Synthetic oligonucleotide
tatttctgtttcactttggtatcaa

SEQ ID NO: 737791 - DNA, 25 bp, Artificial sequence
  Synthetic oligonucleotide
gagagttcgacttcgattgtgtagt

SEQ ID NO: 737792 - DNA, 25 bp, Artificial sequence
  Synthetic oligonucleotide
gagagttcgactacgattgtgtagt

SEQ ID NO: 737793 - DNA, 25 bp, Artificial sequence
  Synthetic oligonucleotide
tgtttttggcaatagacgtttgtga

SEQ ID NO: 737794 - DNA, 25 bp, Artificial sequence
  Synthetic oligonucleotide
tgtttttggcaaaagacgtttgtga

SEQ ID NO: 737795 - DNA, 25 bp, Artificial sequence
  Synthetic oligonucleotide
gggcttacacaagataatggacttt

SEQ ID NO: 737796 - DNA, 25 bp, Artificial sequence
  Synthetic oligonucleotide
gggcttacacaacataatggacttt

SEQ ID NO: 737797 - DNA, 25 bp, Artificial sequence
  Synthetic oligonucleotide
gctattgggtttcaagccatttcaa

SEQ ID NO: 737798 - DNA, 25 bp, Artificial sequence
  Synthetic oligonucleotide
gctattgggtttgaagccatttcaa

SEQ ID NO: 737799 - DNA, 25 bp, Artificial sequence
  Synthetic oligonucleotide
tgaatttttcttctagttttgactc

SEQ ID NO: 737800 - DNA, 25 bp, Artificial sequence
  Synthetic oligonucleotide
tgaatttttcttgtagttttgactc

SEQ ID NO: 737801 - DNA, 25 bp, Artificial sequence
  Synthetic oligonucleotide
cctctgttaccgtaacttgaagaaa

SEQ ID NO: 737802 - DNA, 25 bp, Artificial sequence
  Synthetic oligonucleotide
ggagattatctccaaacctttttaa

SEQ ID NO: 737803 - DNA, 25 bp, Artificial sequence
  Synthetic oligonucleotide
taggatcaatacaaaagagcacatg

SEQ ID NO: 737804 - DNA, 25 bp, Artificial sequence
  Synthetic oligonucleotide
tcacaagattattggcgacagtagc

SEQ ID NO: 737805 - DNA, 25 bp, Artificial sequence
  Synthetic oligonucleotide
ttaacgataataccaaccgtccacg

SEQ ID NO: 737806 - DNA, 25 bp, Artificial sequence
  Synthetic oligonucleotide
ttaacgataatagcaaccgtccacg

SEQ ID NO: 737807 - DNA, 25 bp, Artificial sequence
  Synthetic oligonucleotide
ggcccaagaacagtctcacttacat

SEQ ID NO: 737808 - DNA, 25 bp, Artificial sequence
  Synthetic oligonucleotide
ggcccaagaacactctcacttacat

SEQ ID NO: 737809 - DNA, 25 bp, Artificial sequence
  Synthetic oligonucleotide
gtacccttcttcttcctcctctctg

SEQ ID NO: 737810 - DNA, 25 bp, Artificial sequence
  Synthetic oligonucleotide
gtacccttcttcatcctcctctctg

SEQ ID NO: 737811 - DNA, 25 bp, Artificial sequence
  Synthetic oligonucleotide
caagtactacaaaaattctctcaca

SEQ ID NO: 737812 - DNA, 25 bp, Artificial sequence
  Synthetic oligonucleotide
caagtactacaataattctctcaca

SEQ ID NO: 737813 - DNA, 25 bp, Artificial sequence
  Synthetic oligonucleotide
gaaggtaaagccatcgcgacgtctc

SEQ ID NO: 737814 - DNA, 25 bp, Artificial sequence
  Synthetic oligonucleotide
gaaggtaaagccttcgcgacgtctc

SEQ ID NO: 737815 - DNA, 25 bp, Artificial sequence
  Synthetic oligonucleotide
cgtgtattgatattcccgtgttctc

SEQ ID NO: 737816 - DNA, 25 bp, Artificial sequence
  Synthetic oligonucleotide
cgtgtattgataatcccgtgttctc

SEQ ID NO: 737817 - DNA, 25 bp, Artificial sequence
  Synthetic oligonucleotide
tcgtttttacatgccggctctctag

SEQ ID NO: 737818 - DNA, 25 bp, Artificial sequence
  Synthetic oligonucleotide
cctctgttaccgaaacttgaagaaa

SEQ ID NO: 737819 - DNA, 25 bp, Artificial sequence
  Synthetic oligonucleotide
tggtaatccaaataggaaaacttca

SEQ ID NO: 737820 - DNA, 25 bp, Artificial sequence
  Synthetic oligonucleotide
tagacaaagtgtgggcacgcatgga

SEQ ID NO: 737821 - DNA, 25 bp, Artificial sequence
  Synthetic oligonucleotide
tagacaaagtgtcggcacgcatgga

SEQ ID NO: 737822 - DNA, 25 bp, Artificial sequence
  Synthetic oligonucleotide
aaatgccatcttctctcttggacag

SEQ ID NO: 737823 - DNA, 25 bp, Artificial sequence
  Synthetic oligonucleotide
aaatgccatcttgtctcttggacag

SEQ ID NO: 737824 - DNA, 25 bp, Artificial sequence
  Synthetic oligonucleotide
tagacatgaacaggtcaggttctct

SEQ ID NO: 737825 - DNA, 25 bp, Artificial sequence
  Synthetic oligonucleotide
tagacatgaacacgtcaggttctct

SEQ ID NO: 737826 - DNA, 25 bp, Artificial sequence
  Synthetic oligonucleotide
taaactgcttatattgtcggtagca

SEQ ID NO: 737827 - DNA, 25 bp, Artificial sequence
  Synthetic oligonucleotide
taaactgcttattttgtcggtagca

SEQ ID NO: 737828 - DNA, 25 bp, Artificial sequence
  Synthetic oligonucleotide
aaaaccccacttactctcaatttca

SEQ ID NO: 737829 - DNA, 25 bp, Artificial sequence
  Synthetic oligonucleotide
aaaaccccactttctctcaatttca

SEQ ID NO: 737830 - DNA, 25 bp, Artificial sequence
  Synthetic oligonucleotide
cccggaaattttcaagtcaacagat

SEQ ID NO: 737831 - DNA, 25 bp, Artificial sequence
  Synthetic oligonucleotide
cccggaaattttgaagtcaacagat

SEQ ID NO: 737832 - DNA, 25 bp, Artificial sequence
  Synthetic oligonucleotide
tgctaaaaaggtcaaattgagtaag

SEQ ID NO: 737833 - DNA, 25 bp, Artificial sequence
  Synthetic oligonucleotide
tatttctgtttctctttggtatcaa

SEQ ID NO: 737834 - DNA, 25 bp, Artificial sequence
  Synthetic oligonucleotide
tcgaactgaatcaaacaccaacact

SEQ ID NO: 737835 - DNA, 25 bp, Artificial sequence
  Synthetic oligonucleotide
aaagcgtgcgtctatcggtggtgct

SEQ ID NO: 737836 - DNA, 25 bp, Artificial sequence
  Synthetic oligonucleotide
taagaaagtctaccttccattgaag

SEQ ID NO: 737837 - DNA, 25 bp, Artificial sequence
  Synthetic oligonucleotide
taagaaagtctagcttccattgaag

SEQ ID NO: 737838 - DNA, 25 bp, Artificial sequence
  Synthetic oligonucleotide
cgactaatgaaaactgaaaattatc

SEQ ID NO: 737839 - DNA, 25 bp, Artificial sequence
  Synthetic oligonucleotide
cgactaatgaaatctgaaaattatc

SEQ ID NO: 737840 - DNA, 25 bp, Artificial sequence
  Synthetic oligonucleotide
tgctaaaaaggtgaaattgagtaag

SEQ ID NO: 737841 - DNA, 25 bp, Artificial sequence
  Synthetic oligonucleotide
gaaggatccagctttggaagctcga

SEQ ID NO: 737842 - DNA, 25 bp, Artificial sequence
  Synthetic oligonucleotide
tggtaatccaaaaaggaaaacttca

SEQ ID NO: 737843 - DNA, 25 bp, Artificial sequence
  Synthetic oligonucleotide
tcgaactgaatctaacaccaacact

SEQ ID NO: 737844 - DNA, 25 bp, Artificial sequence
  Synthetic oligonucleotide
cattctagaatctctcttatttgag

SEQ ID NO: 737845 - DNA, 25 bp, Artificial sequence
  Synthetic oligonucleotide
cattctagaatcactcttatttgag

SEQ ID NO: 737846 - DNA, 25 bp, Artificial sequence
  Synthetic oligonucleotide
gacagcagaacagagtctacctttc

SEQ ID NO: 737847 - DNA, 25 bp, Artificial sequence
  Synthetic oligonucleotide
gacagcagaacacagtctacctttc

SEQ ID NO: 737848 - DNA, 25 bp, Artificial sequence
  Synthetic oligonucleotide
tcacaagattataggcgacagtagc

SEQ ID NO: 737849 - DNA, 25 bp, Artificial sequence
  Synthetic oligonucleotide
gaaggatccagcattggaagctcga

SEQ ID NO: 737850 - DNA, 25 bp, Artificial sequence
  Synthetic oligonucleotide
ttttaagttttgcgtttgctcagtg

SEQ ID NO: 737851 - DNA, 25 bp, Artificial sequence
  Synthetic oligonucleotide
tcgtttttacatcccggctctctag

SEQ ID NO: 737852 - DNA, 25 bp, Artificial sequence
  Synthetic oligonucleotide
gaagagagaaaatgaagcagctgtg

SEQ ID NO: 737853 - DNA, 25 bp, Artificial sequence
  Synthetic oligonucleotide
gggagtggtctctactcacattgtg

SEQ ID NO: 737854 - DNA, 25 bp, Artificial sequence
  Synthetic oligonucleotide
gggagtggtctcaactcacattgtg

SEQ ID NO: 737855 - DNA, 25 bp, Artificial sequence
  Synthetic oligonucleotide
gctcacaatggctgaagcaatgcct

SEQ ID NO: 737856 - DNA, 25 bp, Artificial sequence
  Synthetic oligonucleotide
gctcacaatggcagaagcaatgcct

SEQ ID NO: 737857 - DNA, 25 bp, Artificial sequence
  Synthetic oligonucleotide
gctacttcagctgttgtcaccatcg

SEQ ID NO: 737858 - DNA, 25 bp, Artificial sequence
  Synthetic oligonucleotide
gctacttcagctcttgtcaccatcg

SEQ ID NO: 737859 - DNA, 25 bp, Artificial sequence
  Synthetic oligonucleotide
aactgtttgtactatttcggtaagc

SEQ ID NO: 737860 - DNA, 25 bp, Artificial sequence
  Synthetic oligonucleotide
aactgtttgtacaatttcggtaagc

SEQ ID NO: 737861 - DNA, 25 bp, Artificial sequence
  Synthetic oligonucleotide
aactgtgtggcatctgtgggaagac

SEQ ID NO: 737862 - DNA, 25 bp, Artificial sequence
  Synthetic oligonucleotide
aactgtgtggcaactgtgggaagac

SEQ ID NO: 737863 - DNA, 25 bp, Artificial sequence
  Synthetic oligonucleotide
ggtggactctccgttcttcctcaag

SEQ ID NO: 737864 - DNA, 25 bp, Artificial sequence
  Synthetic oligonucleotide
tgttaggaaaccattcgttgctttc

SEQ ID NO: 737865 - DNA, 25 bp, Artificial sequence
  Synthetic oligonucleotide
cagatcatgtggtcaacatttgtcc

SEQ ID NO: 737866 - DNA, 25 bp, Artificial sequence
  Synthetic oligonucleotide
tctgttgtcctaattggtagtagaa

SEQ ID NO: 737867 - DNA, 25 bp, Artificial sequence
  Synthetic oligonucleotide
tactttccccccataattttatctg

SEQ ID NO: 737868 - DNA, 25 bp, Artificial sequence
  Synthetic oligonucleotide
tactttccccccttaattttatctg

SEQ ID NO: 737869 - DNA, 25 bp, Artificial sequence
  Synthetic oligonucleotide
tgctgtggcagcaataatcatggta

SEQ ID NO: 737870 - DNA, 25 bp, Artificial sequence
  Synthetic oligonucleotide
tgctgtggcagctataatcatggta

SEQ ID NO: 737871 - DNA, 25 bp, Artificial sequence
  Synthetic oligonucleotide
ggtggactctcccttcttcctcaag

SEQ ID NO: 737872 - DNA, 25 bp, Artificial sequence
  Synthetic oligonucleotide
caaacagtatcttgcctgggacaac

SEQ ID NO: 737873 - DNA, 25 bp, Artificial sequence
  Synthetic oligonucleotide
ttttaagttttgggtttgctcagtg

SEQ ID NO: 737874 - DNA, 25 bp, Artificial sequence
  Synthetic oligonucleotide
cagatcatgtggacaacatttgtcc

SEQ ID NO: 737875 - DNA, 25 bp, Artificial sequence
  Synthetic oligonucleotide
tgttttaattaaatcgacacttcga

SEQ ID NO: 737876 - DNA, 25 bp, Artificial sequence
  Synthetic oligonucleotide
tgttttaattaattcgacacttcga

SEQ ID NO: 737877 - DNA, 25 bp, Artificial sequence
  Synthetic oligonucleotide
catgtattccaaaggcattagacta

SEQ ID NO: 737878 - DNA, 25 bp, Artificial sequence
  Synthetic oligonucleotide
catgtattccaatggcattagacta

SEQ ID NO: 737879 - DNA, 25 bp, Artificial sequence
  Synthetic oligonucleotide
tgttaggaaacctttcgttgctttc

SEQ ID NO: 737880 - DNA, 25 bp, Artificial sequence
  Synthetic oligonucleotide
caaacagtatctagcctgggacaac

SEQ ID NO: 737881 - DNA, 25 bp, Artificial sequence
  Synthetic oligonucleotide
caagaatgggactcatggacggcca

SEQ ID NO: 737882 - DNA, 25 bp, Artificial sequence
  Synthetic oligonucleotide
gacattggttagacatatcagtcac

SEQ ID NO: 737883 - DNA, 25 bp, Artificial sequence
  Synthetic oligonucleotide
tcaatggcttgagtcggtggaattc

SEQ ID NO: 737884 - DNA, 25 bp, Artificial sequence
  Synthetic oligonucleotide
tcaatggcttgactcggtggaattc

SEQ ID NO: 737885 - DNA, 25 bp, Artificial sequence
  Synthetic oligonucleotide
gactcgccgactcgttcctgttcgt

SEQ ID NO: 737886 - DNA, 25 bp, Artificial sequence
  Synthetic oligonucleotide
gactcgccgactggttcctgttcgt

SEQ ID NO: 737887 - DNA, 25 bp, Artificial sequence
  Synthetic oligonucleotide
tcggaatcggacacggactccgact

SEQ ID NO: 737888 - DNA, 25 bp, Artificial sequence
  Synthetic oligonucleotide
tcggaatcggactcggactccgact

SEQ ID NO: 737889 - DNA, 25 bp, Artificial sequence
  Synthetic oligonucleotide
cagcaggtgcggattgaatttctga

SEQ ID NO: 737890 - DNA, 25 bp, Artificial sequence
  Synthetic oligonucleotide
cagcaggtgcggtttgaatttctga

SEQ ID NO: 737891 - DNA, 25 bp, Artificial sequence
  Synthetic oligonucleotide
tctaaaatcaaaggctcaattttgt

SEQ ID NO: 737892 - DNA, 25 bp, Artificial sequence
  Synthetic oligonucleotide
tctaaaatcaaacgctcaattttgt

SEQ ID NO: 737893 - DNA, 25 bp, Artificial sequence
  Synthetic oligonucleotide
tggttggtggatgttttttattttg

SEQ ID NO: 737894 - DNA, 25 bp, Artificial sequence
  Synthetic oligonucleotide
tggttggtggatcttttttattttg

SEQ ID NO: 737895 - DNA, 25 bp, Artificial sequence
  Synthetic oligonucleotide
gaagagagaaaaagaagcagctgtg

SEQ ID NO: 737896 - DNA, 25 bp, Artificial sequence
  Synthetic oligonucleotide
gaaacaataccggtctttcggctgt

SEQ ID NO: 737897 - DNA, 25 bp, Artificial sequence
  Synthetic oligonucleotide
tagagtttgtttattggatacaggg

SEQ ID NO: 737898 - DNA, 25 bp, Artificial sequence
  Synthetic oligonucleotide
tagagtttgttttttggatacaggg

SEQ ID NO: 737899 - DNA, 25 bp, Artificial sequence
  Synthetic oligonucleotide
ggatttagtggaagtgatagataga

SEQ ID NO: 737900 - DNA, 25 bp, Artificial sequence
  Synthetic oligonucleotide
ggatttagtggatgtgatagataga

SEQ ID NO: 737901 - DNA, 25 bp, Artificial sequence
  Synthetic oligonucleotide
aaagatattatattacatagatcag

SEQ ID NO: 737902 - DNA, 25 bp, Artificial sequence
  Synthetic oligonucleotide
tctcaaagggaaatccaggtttggg

SEQ ID NO: 737903 - DNA, 25 bp, Artificial sequence
  Synthetic oligonucleotide
gaaacaataccgctctttcggctgt

SEQ ID NO: 737904 - DNA, 25 bp, Artificial sequence
  Synthetic oligonucleotide
tctcaaagggaattccaggtttggg

SEQ ID NO: 737905 - DNA, 25 bp, Artificial sequence
  Synthetic oligonucleotide
tcagatcatcctgaatacccagaat

SEQ ID NO: 737906 - DNA, 25 bp, Artificial sequence
  Synthetic oligonucleotide
tcagatcatcctcaatacccagaat

SEQ ID NO: 737907 - DNA, 25 bp, Artificial sequence
  Synthetic oligonucleotide
ggagcaaacattgcgtttctcatgc

SEQ ID NO: 737908 - DNA, 25 bp, Artificial sequence
  Synthetic oligonucleotide
ggagcaaacattccgtttctcatgc

SEQ ID NO: 737909 - DNA, 25 bp, Artificial sequence
  Synthetic oligonucleotide
caagaatgggacacatggacggcca

SEQ ID NO: 737910 - DNA, 25 bp, Artificial sequence
  Synthetic oligonucleotide
aaagcgtgcgtcaatcggtggtgct

SEQ ID NO: 737911 - DNA, 25 bp, Artificial sequence
  Synthetic oligonucleotide
aaagatattataatacatagatcag

SEQ ID NO: 737912 - DNA, 25 bp, Artificial sequence
  Synthetic oligonucleotide
caattaagattggtgatcaaaacat

SEQ ID NO: 737913 - DNA, 25 bp, Artificial sequence
  Synthetic oligonucleotide
gagctggaaaaaaaaattagttctc

SEQ ID NO: 737914 - DNA, 25 bp, Artificial sequence
  Synthetic oligonucleotide
ccgcagggccggctcagaataataa

SEQ ID NO: 737915 - DNA, 25 bp, Artificial sequence
  Synthetic oligonucleotide
ccgcagggccgggtcagaataataa

SEQ ID NO: 737916 - DNA, 25 bp, Artificial sequence
  Synthetic oligonucleotide
cagaggtttctagttctgcacataa

SEQ ID NO: 737917 - DNA, 25 bp, Artificial sequence
  Synthetic oligonucleotide
cagaggtttctacttctgcacataa

SEQ ID NO: 737918 - DNA, 25 bp, Artificial sequence
  Synthetic oligonucleotide
ggccttccttaaatgattacctctg

SEQ ID NO: 737919 - DNA, 25 bp, Artificial sequence
  Synthetic oligonucleotide
ggccttccttaattgattacctctg

SEQ ID NO: 737920 - DNA, 25 bp, Artificial sequence
  Synthetic oligonucleotide
gctttcttattgatgaggttggcat

SEQ ID NO: 737921 - DNA, 25 bp, Artificial sequence
  Synthetic oligonucleotide
gctttcttattgttgaggttggcat

SEQ ID NO: 737922 - DNA, 25 bp, Artificial sequence
  Synthetic oligonucleotide
catcgttggatactcccccgaggat

SEQ ID NO: 737923 - DNA, 25 bp, Artificial sequence
  Synthetic oligonucleotide
tcagttaattacttagttggcccac

SEQ ID NO: 737924 - DNA, 25 bp, Artificial sequence
  Synthetic oligonucleotide
gttatatatcaatatttttggaccc

SEQ ID NO: 737925 - DNA, 25 bp, Artificial sequence
  Synthetic oligonucleotide
caattaagattgctgatcaaaacat

SEQ ID NO: 737926 - DNA, 25 bp, Artificial sequence
  Synthetic oligonucleotide
gattatgggccggaaatccatgatt

SEQ ID NO: 737927 - DNA, 25 bp, Artificial sequence
  Synthetic oligonucleotide
gattatgggccgcaaatccatgatt

SEQ ID NO: 737928 - DNA, 25 bp, Artificial sequence
  Synthetic oligonucleotide
taaacttcaacaatcattcatacca

SEQ ID NO: 737929 - DNA, 25 bp, Artificial sequence
  Synthetic oligonucleotide
taaacttcaacattcattcatacca

SEQ ID NO: 737930 - DNA, 25 bp, Artificial sequence
  Synthetic oligonucleotide
ttagaacagtgaacaaaagaagagc

SEQ ID NO: 737931 - DNA, 25 bp, Artificial sequence
  Synthetic oligonucleotide
ttagaacagtgatcaaaagaagagc

SEQ ID NO: 737932 - DNA, 25 bp, Artificial sequence
  Synthetic oligonucleotide
gaattttatattgtctcattaagaa

SEQ ID NO: 737933 - DNA, 25 bp, Artificial sequence
  Synthetic oligonucleotide
gaattttatattctctcattaagaa

SEQ ID NO: 737934 - DNA, 25 bp, Artificial sequence
  Synthetic oligonucleotide
tcagttaattacatagttggcccac

SEQ ID NO: 737935 - DNA, 25 bp, Artificial sequence
  Synthetic oligonucleotide
gttacagattcacactactttactc

SEQ ID NO: 737936 - DNA, 25 bp, Artificial sequence
  Synthetic oligonucleotide
catcgttggatagtcccccgaggat

SEQ ID NO: 737937 - DNA, 25 bp, Artificial sequence
  Synthetic oligonucleotide
tctctccctctcattcgcttcttcc

SEQ ID NO: 737938 - DNA, 25 bp, Artificial sequence
  Synthetic oligonucleotide
tctctccctctctttcgcttcttcc

SEQ ID NO: 737939 - DNA, 25 bp, Artificial sequence
  Synthetic oligonucleotide
gaatcctctgttttgctcttgcctt

SEQ ID NO: 737940 - DNA, 25 bp, Artificial sequence
  Synthetic oligonucleotide
gaatcctctgttatgctcttgcctt

SEQ ID NO: 737941 - DNA, 25 bp, Artificial sequence
  Synthetic oligonucleotide
gaaaaacaaacgaactcaaatggct

SEQ ID NO: 737942 - DNA, 25 bp, Artificial sequence
  Synthetic oligonucleotide
gaaaaacaaacgtactcaaatggct

SEQ ID NO: 737943 - DNA, 25 bp, Artificial sequence
  Synthetic oligonucleotide
ggctcttctcttgcatttcctctta

SEQ ID NO: 737944 - DNA, 25 bp, Artificial sequence
  Synthetic oligonucleotide
ggctcttctcttccatttcctctta

SEQ ID NO: 737945 - DNA, 25 bp, Artificial sequence
  Synthetic oligonucleotide
gagctggaaaaataaattagttctc

SEQ ID NO: 737946 - DNA, 25 bp, Artificial sequence
  Synthetic oligonucleotide
gagcgacctctatcgagtctccagc

SEQ ID NO: 737947 - DNA, 25 bp, Artificial sequence
  Synthetic oligonucleotide
gttatatatcaaaatttttggaccc

SEQ ID NO: 737948 - DNA, 25 bp, Artificial sequence
  Synthetic oligonucleotide
gttacagattcagactactttactc

SEQ ID NO: 737949 - DNA, 25 bp, Artificial sequence
  Synthetic oligonucleotide
caaaactaagcttaaagacacagac

SEQ ID NO: 737950 - DNA, 25 bp, Artificial sequence
  Synthetic oligonucleotide
caaaactaagctaaaagacacagac

SEQ ID NO: 737951 - DNA, 25 bp, Artificial sequence
  Synthetic oligonucleotide
tacttggagtcaaagtaacctcatg

SEQ ID NO: 737952 - DNA, 25 bp, Artificial sequence
  Synthetic oligonucleotide
tacttggagtcatagtaacctcatg

SEQ ID NO: 737953 - DNA, 25 bp, Artificial sequence
  Synthetic oligonucleotide
cagcacatgtgtaaagccggcctgc

SEQ ID NO: 737954 - DNA, 25 bp, Artificial sequence
  Synthetic oligonucleotide
cagcacatgtgttaagccggcctgc

SEQ ID NO: 737955 - DNA, 25 bp, Artificial sequence
  Synthetic oligonucleotide
aagaaattttggctagaccctgtgc

SEQ ID NO: 737956 - DNA, 25 bp, Artificial sequence
  Synthetic oligonucleotide
aagaaattttgggtagaccctgtgc

SEQ ID NO: 737957 - DNA, 25 bp, Artificial sequence
  Synthetic oligonucleotide
gttctttacagattaaatatcttat

SEQ ID NO: 737958 - DNA, 25 bp, Artificial sequence
  Synthetic oligonucleotide
gagcgacctctaacgagtctccagc

SEQ ID NO: 737959 - DNA, 25 bp, Artificial sequence
  Synthetic oligonucleotide
taacggccatgatgaaaaaccccat

SEQ ID NO: 737960 - DNA, 25 bp, Artificial sequence
  Synthetic oligonucleotide
gaaatatacttcaccgtaatctcat

SEQ ID NO: 737961 - DNA, 25 bp, Artificial sequence
  Synthetic oligonucleotide
gagatcccgtgagaagtagacctaa

SEQ ID NO: 737962 - DNA, 25 bp, Artificial sequence
  Synthetic oligonucleotide
tgctctgcgggaataataaaagttg

SEQ ID NO: 737963 - DNA, 25 bp, Artificial sequence
  Synthetic oligonucleotide
tgctctgcgggattaataaaagttg

SEQ ID NO: 737964 - DNA, 25 bp, Artificial sequence
  Synthetic oligonucleotide
ccaaaattgcaaaagaagaaaacca

SEQ ID NO: 737965 - DNA, 25 bp, Artificial sequence
  Synthetic oligonucleotide
ccaaaattgcaatagaagaaaacca

SEQ ID NO: 737966 - DNA, 25 bp, Artificial sequence
  Synthetic oligonucleotide
catgaagccttttttattatgctcg

SEQ ID NO: 737967 - DNA, 25 bp, Artificial sequence
  Synthetic oligonucleotide
catgaagcctttattattatgctcg

SEQ ID NO: 737968 - DNA, 25 bp, Artificial sequence
  Synthetic oligonucleotide
ataccaactgtacggaataccagcg

SEQ ID NO: 737969 - DNA, 25 bp, Artificial sequence
  Synthetic oligonucleotide
agtgcccacaatagccccaagctta

SEQ ID NO: 737970 - DNA, 25 bp, Artificial sequence
  Synthetic oligonucleotide
taacggccatgaagaaaaaccccat

SEQ ID NO: 737971 - DNA, 25 bp, Artificial sequence
  Synthetic oligonucleotide
agtgcccacaattgccccaagctta

SEQ ID NO: 737972 - DNA, 25 bp, Artificial sequence
  Synthetic oligonucleotide
gacacgacctatgttgtcgatgaag

SEQ ID NO: 737973 - DNA, 25 bp, Artificial sequence
  Synthetic oligonucleotide
gacacgacctatcttgtcgatgaag

SEQ ID NO: 737974 - DNA, 25 bp, Artificial sequence
  Synthetic oligonucleotide
ccaataaccgggtatggtggagcaa

SEQ ID NO: 737975 - DNA, 25 bp, Artificial sequence
  Synthetic oligonucleotide
ccaataaccgggaatggtggagcaa

SEQ ID NO: 737976 - DNA, 25 bp, Artificial sequence
  Synthetic oligonucleotide
gatggctcctaattccgccacttca

SEQ ID NO: 737977 - DNA, 25 bp, Artificial sequence
  Synthetic oligonucleotide
gatggctcctaaatccgccacttca

SEQ ID NO: 737978 - DNA, 25 bp, Artificial sequence
  Synthetic oligonucleotide
tcgtagacgtttactgcagtggaag

SEQ ID NO: 737979 - DNA, 25 bp, Artificial sequence
  Synthetic oligonucleotide
tcgtagacgttttctgcagtggaag

SEQ ID NO: 737980 - DNA, 25 bp, Artificial sequence
  Synthetic oligonucleotide
tctgtggctcatgttcagactcagc

SEQ ID NO: 737981 - DNA, 25 bp, Artificial sequence
  Synthetic oligonucleotide
taaatgaatccagtttatgaaaaat

SEQ ID NO: 737982 - DNA, 25 bp, Artificial sequence
  Synthetic oligonucleotide
ataccaactgtagggaataccagcg

SEQ ID NO: 737983 - DNA, 25 bp, Artificial sequence
  Synthetic oligonucleotide
tagatcatacttcgtagtggttggt

SEQ ID NO: 737984 - DNA, 25 bp, Artificial sequence
  Synthetic oligonucleotide
ggtcatgctcgtactcctctaacga

SEQ ID NO: 737985 - DNA, 25 bp, Artificial sequence
  Synthetic oligonucleotide
gttctttacagaataaatatcttat

SEQ ID NO: 737986 - DNA, 25 bp, Artificial sequence
  Synthetic oligonucleotide
gaaatcttggtggattgacaggtca

SEQ ID NO: 737987 - DNA, 25 bp, Artificial sequence
  Synthetic oligonucleotide
gaaatcttggtgcattgacaggtca

SEQ ID NO: 737988 - DNA, 25 bp, Artificial sequence
  Synthetic oligonucleotide
taaaacgaagatccttatcctcctg

SEQ ID NO: 737989 - DNA, 25 bp, Artificial sequence
  Synthetic oligonucleotide
taaaacgaagatgcttatcctcctg

SEQ ID NO: 737990 - DNA, 25 bp, Artificial sequence
  Synthetic oligonucleotide
tttatatatcttattcaacaattag

SEQ ID NO: 737991 - DNA, 25 bp, Artificial sequence
  Synthetic oligonucleotide
tttatatatctttttcaacaattag

SEQ ID NO: 737992 - DNA, 25 bp, Artificial sequence
  Synthetic oligonucleotide
tcattataaaaatcaagtttttacg

SEQ ID NO: 737993 - DNA, 25 bp, Artificial sequence
  Synthetic oligonucleotide
gagatcccgtgacaagtagacctaa

SEQ ID NO: 737994 - DNA, 25 bp, Artificial sequence
  Synthetic oligonucleotide
tagatcatacttggtagtggttggt

SEQ ID NO: 737995 - DNA, 25 bp, Artificial sequence
  Synthetic oligonucleotide
gaaatatacttctccgtaatctcat

SEQ ID NO: 737996 - DNA, 25 bp, Artificial sequence
  Synthetic oligonucleotide
taaatgaatccactttatgaaaaat

SEQ ID NO: 737997 - DNA, 25 bp, Artificial sequence
  Synthetic oligonucleotide
ggtcatgctcgttctcctctaacga

SEQ ID NO: 737998 - DNA, 25 bp, Artificial sequence
  Synthetic oligonucleotide
tttccttggtgaagaaatacgtcac

SEQ ID NO: 737999 - DNA, 25 bp, Artificial sequence
  Synthetic oligonucleotide
tttccttggtgatgaaatacgtcac

SEQ ID NO: 738000 - DNA, 25 bp, Artificial sequence
  Synthetic oligonucleotide
aatgcaaacgcctccaagaatcaag

SEQ ID NO: 738001 - DNA, 25 bp, Artificial sequence
  Synthetic oligonucleotide
aatgcaaacgccaccaagaatcaag

SEQ ID NO: 738002 - DNA, 25 bp, Artificial sequence
  Synthetic oligonucleotide
catacggtttacttcgggataaatc

SEQ ID NO: 738003 - DNA, 25 bp, Artificial sequence
  Synthetic oligonucleotide
catacggtttacatcgggataaatc

SEQ ID NO: 738004 - DNA, 25 bp, Artificial sequence
  Synthetic oligonucleotide
tcatcgctttccatcttcttggtag

SEQ ID NO: 738005 - DNA, 25 bp, Artificial sequence
  Synthetic oligonucleotide
tcatcgctttccttcttcttggtag

SEQ ID NO: 738006 - DNA, 25 bp, Artificial sequence
  Synthetic oligonucleotide
tcattataaaaaacaagtttttacg

SEQ ID NO: 738007 - DNA, 25 bp, Artificial sequence
  Synthetic oligonucleotide
cattgtgaagaaatcttggggacca

SEQ ID NO: 738008 - DNA, 25 bp, Artificial sequence
  Synthetic oligonucleotide
agtgtcttcgttatttctcttttga

SEQ ID NO: 738009 - DNA, 25 bp, Artificial sequence
  Synthetic oligonucleotide
agtgtcttcgttttttctcttttga

SEQ ID NO: 738010 - DNA, 25 bp, Artificial sequence
  Synthetic oligonucleotide
ctctcttatctgcatttgatcagca

SEQ ID NO: 738011 - DNA, 25 bp, Artificial sequence
  Synthetic oligonucleotide
ctctcttatctggatttgatcagca

SEQ ID NO: 738012 - DNA, 25 bp, Artificial sequence
  Synthetic oligonucleotide
tctttccccacctaaactaagtgat

SEQ ID NO: 738013 - DNA, 25 bp, Artificial sequence
  Synthetic oligonucleotide
tctttccccaccaaaactaagtgat

SEQ ID NO: 738014 - DNA, 25 bp, Artificial sequence
  Synthetic oligonucleotide
ccagagggtctctgtggaatcaaca

SEQ ID NO: 738015 - DNA, 25 bp, Artificial sequence
  Synthetic oligonucleotide
ccagagggtctcagtggaatcaaca

SEQ ID NO: 738016 - DNA, 25 bp, Artificial sequence
  Synthetic oligonucleotide
gaaaaaggttacatcaggctgaaga

SEQ ID NO: 738017 - DNA, 25 bp, Artificial sequence
  Synthetic oligonucleotide
tagcggcgtaagaacattataaacc

SEQ ID NO: 738018 - DNA, 25 bp, Artificial sequence
  Synthetic oligonucleotide
cattgtgaagaattcttggggacca

SEQ ID NO: 738019 - DNA, 25 bp, Artificial sequence
  Synthetic oligonucleotide
tatataagaagctgagaattgacaa

SEQ ID NO: 738020 - DNA, 25 bp, Artificial sequence
  Synthetic oligonucleotide
tgggtatggatctagcaagggttca

SEQ ID NO: 738021 - DNA, 25 bp, Artificial sequence
  Synthetic oligonucleotide
tgggtatggatcaagcaagggttca

SEQ ID NO: 738022 - DNA, 25 bp, Artificial sequence
  Synthetic oligonucleotide
cggtgcggggttcatcttgaccacg

SEQ ID NO: 738023 - DNA, 25 bp, Artificial sequence
  Synthetic oligonucleotide
cggtgcggggttgatcttgaccacg

SEQ ID NO: 738024 - DNA, 25 bp, Artificial sequence
  Synthetic oligonucleotide
cattttgtatttggtatatgaaggg

SEQ ID NO: 738025 - DNA, 25 bp, Artificial sequence
  Synthetic oligonucleotide
cattttgtatttcgtatatgaaggg

SEQ ID NO: 738026 - DNA, 25 bp, Artificial sequence
  Synthetic oligonucleotide
gaaaatggttgtaagttaattgctc

SEQ ID NO: 738027 - DNA, 25 bp, Artificial sequence
  Synthetic oligonucleotide
gaaaatggttgttagttaattgctc

SEQ ID NO: 738028 - DNA, 25 bp, Artificial sequence
  Synthetic oligonucleotide
tagcggcgtaagtacattataaacc

SEQ ID NO: 738029 - DNA, 25 bp, Artificial sequence
  Synthetic oligonucleotide
gaaaaaggttacttcaggctgaaga

SEQ ID NO: 738030 - DNA, 25 bp, Artificial sequence
  Synthetic oligonucleotide
tcttgggtaagatgcaattggaaaa

SEQ ID NO: 738031 - DNA, 25 bp, Artificial sequence
  Synthetic oligonucleotide
gaagcaaagtgctcacggaggattg

SEQ ID NO: 738032 - DNA, 25 bp, Artificial sequence
  Synthetic oligonucleotide
tctgtggctcatcttcagactcagc

SEQ ID NO: 738033 - DNA, 25 bp, Artificial sequence
  Synthetic oligonucleotide
tgacaaactcatagaactcttcgaa

SEQ ID NO: 738034 - DNA, 25 bp, Artificial sequence
  Synthetic oligonucleotide
gaagcaaagtgcacacggaggattg

SEQ ID NO: 738035 - DNA, 25 bp, Artificial sequence
  Synthetic oligonucleotide
tcatgtgttcaatatgtcgagatca

SEQ ID NO: 738036 - DNA, 25 bp, Artificial sequence
  Synthetic oligonucleotide
tcatgtgttcaaaatgtcgagatca

SEQ ID NO: 738037 - DNA, 25 bp, Artificial sequence
  Synthetic oligonucleotide
gcagaaatatacaattgtatgaact

SEQ ID NO: 738038 - DNA, 25 bp, Artificial sequence
  Synthetic oligonucleotide
gcagaaatatactattgtatgaact

SEQ ID NO: 738039 - DNA, 25 bp, Artificial sequence
  Synthetic oligonucleotide
tcaaagcaaaatctaaacaaaatct

SEQ ID NO: 738040 - DNA, 25 bp, Artificial sequence
  Synthetic oligonucleotide
ggaagtcttgtatcaactatgtgca

SEQ ID NO: 738041 - DNA, 25 bp, Artificial sequence
  Synthetic oligonucleotide
tcttgggtaagaagcaattggaaaa

SEQ ID NO: 738042 - DNA, 25 bp, Artificial sequence
  Synthetic oligonucleotide
ggaagtcttgtaacaactatgtgca

SEQ ID NO: 738043 - DNA, 25 bp, Artificial sequence
  Synthetic oligonucleotide
aaaaaacagaggaaatgtagattaa

SEQ ID NO: 738044 - DNA, 25 bp, Artificial sequence
  Synthetic oligonucleotide
aaaaaacagaggtaatgtagattaa

SEQ ID NO: 738045 - DNA, 25 bp, Artificial sequence
  Synthetic oligonucleotide
aatctttagattgaacagtttacag

SEQ ID NO: 738046 - DNA, 25 bp, Artificial sequence
  Synthetic oligonucleotide
aatctttagattcaacagtttacag

SEQ ID NO: 738047 - DNA, 25 bp, Artificial sequence
  Synthetic oligonucleotide
agtttcttggggtagaaataattga

SEQ ID NO: 738048 - DNA, 25 bp, Artificial sequence
  Synthetic oligonucleotide
agtttcttggggaagaaataattga

SEQ ID NO: 738049 - DNA, 25 bp, Artificial sequence
  Synthetic oligonucleotide
taatgattattgaagaaaagaacag

SEQ ID NO: 738050 - DNA, 25 bp, Artificial sequence
  Synthetic oligonucleotide
caaccatgaagaaattaaagcagag

SEQ ID NO: 738051 - DNA, 25 bp, Artificial sequence
  Synthetic oligonucleotide
tatataagaagcagagaattgacaa

SEQ ID NO: 738052 - DNA, 25 bp, Artificial sequence
  Synthetic oligonucleotide
caaccatgaagatattaaagcagag

SEQ ID NO: 738053 - DNA, 25 bp, Artificial sequence
  Synthetic oligonucleotide
tcaaagcaaaatgtaaacaaaatct

SEQ ID NO: 738054 - DNA, 25 bp, Artificial sequence
  Synthetic oligonucleotide
cgggctcaacgagtttgcggatttg

SEQ ID NO: 738055 - DNA, 25 bp, Artificial sequence
  Synthetic oligonucleotide
aaacttgtttcggaggaagttgttg

SEQ ID NO: 738056 - DNA, 25 bp, Artificial sequence
  Synthetic oligonucleotide
aaacttgtttcgcaggaagttgttg

SEQ ID NO: 738057 - DNA, 25 bp, Artificial sequence
  Synthetic oligonucleotide
ctgatctgttaatggaagttttgac

SEQ ID NO: 738058 - DNA, 25 bp, Artificial sequence
  Synthetic oligonucleotide
ctgatctgttaaaggaagttttgac

SEQ ID NO: 738059 - DNA, 25 bp, Artificial sequence
  Synthetic oligonucleotide
gaaccagggctcatgtggtaatatc

SEQ ID NO: 738060 - DNA, 25 bp, Artificial sequence
  Synthetic oligonucleotide
gaaccagggctcttgtggtaatatc

SEQ ID NO: 738061 - DNA, 25 bp, Artificial sequence
  Synthetic oligonucleotide
ttgactggagaaagaaaggagctgt

SEQ ID NO: 738062 - DNA, 25 bp, Artificial sequence
  Synthetic oligonucleotide
ttgactggagaatgaaaggagctgt

SEQ ID NO: 738063 - DNA, 25 bp, Artificial sequence
  Synthetic oligonucleotide
cttacagggacgtcgaagctgttcc

SEQ ID NO: 738064 - DNA, 25 bp, Artificial sequence
  Synthetic oligonucleotide
gagacgcgatgatgaaagatcttac

SEQ ID NO: 738065 - DNA, 25 bp, Artificial sequence
  Synthetic oligonucleotide
cagtagcagctgtcgaaggtataaa

SEQ ID NO: 738066 - DNA, 25 bp, Artificial sequence
  Synthetic oligonucleotide
caagaaaatgtaattagggctcaag

SEQ ID NO: 738067 - DNA, 25 bp, Artificial sequence
  Synthetic oligonucleotide
cttacagggacgacgaagctgttcc

SEQ ID NO: 738068 - DNA, 25 bp, Artificial sequence
  Synthetic oligonucleotide
cgggctcaacgactttgcggatttg

SEQ ID NO: 738069 - DNA, 25 bp, Artificial sequence
  Synthetic oligonucleotide
catcgatgagacaaacaagaaaggg

SEQ ID NO: 738070 - DNA, 25 bp, Artificial sequence
  Synthetic oligonucleotide
catcgatgagactaacaagaaaggg

SEQ ID NO: 738071 - DNA, 25 bp, Artificial sequence
  Synthetic oligonucleotide
ttcttaggttcgtagttttcaagga

SEQ ID NO: 738072 - DNA, 25 bp, Artificial sequence
  Synthetic oligonucleotide
ttcttaggttcgaagttttcaagga

SEQ ID NO: 738073 - DNA, 25 bp, Artificial sequence
  Synthetic oligonucleotide
tgtcgccattgatgcatctggtaga

SEQ ID NO: 738074 - DNA, 25 bp, Artificial sequence
  Synthetic oligonucleotide
taatgattattgtagaaaagaacag

SEQ ID NO: 738075 - DNA, 25 bp, Artificial sequence
  Synthetic oligonucleotide
aattttgagaaaccttatgaaaccg

SEQ ID NO: 738076 - DNA, 25 bp, Artificial sequence
  Synthetic oligonucleotide
tgacaaactcattgaactcttcgaa

SEQ ID NO: 738077 - DNA, 25 bp, Artificial sequence
  Synthetic oligonucleotide
aattttgagaaagcttatgaaaccg

SEQ ID NO: 738078 - DNA, 25 bp, Artificial sequence
  Synthetic oligonucleotide
caagaaaatgtatttagggctcaag

SEQ ID NO: 738079 - DNA, 25 bp, Artificial sequence
  Synthetic oligonucleotide
tactctatggaacaaggaacttgcg

SEQ ID NO: 738080 - DNA, 25 bp, Artificial sequence
  Synthetic oligonucleotide
gagtctcttgaaggcattggctcat

SEQ ID NO: 738081 - DNA, 25 bp, Artificial sequence
  Synthetic oligonucleotide
taatggacaccaagacgtacctact

SEQ ID NO: 738082 - DNA, 25 bp, Artificial sequence
  Synthetic oligonucleotide
taatggacaccatgacgtacctact

SEQ ID NO: 738083 - DNA, 25 bp, Artificial sequence
  Synthetic oligonucleotide
gagacgcgatgaagaaagatcttac

SEQ ID NO: 738084 - DNA, 25 bp, Artificial sequence
  Synthetic oligonucleotide
cagtagcagctgacgaaggtataaa

SEQ ID NO: 738085 - DNA, 25 bp, Artificial sequence
  Synthetic oligonucleotide
tgttttgaaaacaggatgaatctga

SEQ ID NO: 738086 - DNA, 25 bp, Artificial sequence
  Synthetic oligonucleotide
tgttttgaaaactggatgaatctga

SEQ ID NO: 738087 - DNA, 25 bp, Artificial sequence
  Synthetic oligonucleotide
gatgtgttaatgaaaggtggtccca

SEQ ID NO: 738088 - DNA, 25 bp, Artificial sequence
  Synthetic oligonucleotide
gatgtgttaatgtaaggtggtccca

SEQ ID NO: 738089 - DNA, 25 bp, Artificial sequence
  Synthetic oligonucleotide
ggtcccattctattatcaactcttg

SEQ ID NO: 738090 - DNA, 25 bp, Artificial sequence
  Synthetic oligonucleotide
tactctatggaagaaggaacttgcg

SEQ ID NO: 738091 - DNA, 25 bp, Artificial sequence
  Synthetic oligonucleotide
tgttaagaacggtggtctacgcaag

SEQ ID NO: 738092 - DNA, 25 bp, Artificial sequence
  Synthetic oligonucleotide
caacggtggtctgatggactatgcc

SEQ ID NO: 738093 - DNA, 25 bp, Artificial sequence
  Synthetic oligonucleotide
gacaggaaacttgacaacattgtca

SEQ ID NO: 738094 - DNA, 25 bp, Artificial sequence
  Synthetic oligonucleotide
gagtctcttgaacgcattggctcat

SEQ ID NO: 738095 - DNA, 25 bp, Artificial sequence
  Synthetic oligonucleotide
tgttaagaacggaggtctacgcaag

SEQ ID NO: 738096 - DNA, 25 bp, Artificial sequence
  Synthetic oligonucleotide
gacaggaaacttcacaacattgtca

SEQ ID NO: 738097 - DNA, 25 bp, Artificial sequence
  Synthetic oligonucleotide
tgtcgccattgaagcatctggtaga

SEQ ID NO: 738098 - DNA, 25 bp, Artificial sequence
  Synthetic oligonucleotide
caacggtggtctcatggactatgcc

SEQ ID NO: 738099 - DNA, 25 bp, Artificial sequence
  Synthetic oligonucleotide
catagactgtgagacgacctacaac

SEQ ID NO: 738100 - DNA, 25 bp, Artificial sequence
  Synthetic oligonucleotide
ggtcccattctaatatcaactcttg

SEQ ID NO: 738101 - DNA, 25 bp, Artificial sequence
  Synthetic oligonucleotide
catagactgtgacacgacctacaac

SEQ ID NO: 738102 - DNA, 25 bp, Artificial sequence
  Synthetic oligonucleotide
aatgagcacgtagcctgcttctcca

SEQ ID NO: 738103 - DNA, 25 bp, Artificial sequence
  Synthetic oligonucleotide
aatgagcacgtaccctgcttctcca

SEQ ID NO: 738104 - DNA, 25 bp, Artificial sequence
  Synthetic oligonucleotide
tcttcttatctctgtgatgatcatc

SEQ ID NO: 738105 - DNA, 25 bp, Artificial sequence
  Synthetic oligonucleotide
tcttcttatctcagtgatgatcatc

SEQ ID NO: 738106 - DNA, 25 bp, Artificial sequence
  Synthetic oligonucleotide
gatggatccttagatcaactttgac

SEQ ID NO: 738107 - DNA, 25 bp, Artificial sequence
  Synthetic oligonucleotide
agactgggtcttgtgtagggtattc

SEQ ID NO: 738108 - DNA, 25 bp, Artificial sequence
  Synthetic oligonucleotide
tgttttgatgagacagcctctgcat

SEQ ID NO: 738109 - DNA, 25 bp, Artificial sequence
  Synthetic oligonucleotide
cggaaggagttaaatgtagagacaa

SEQ ID NO: 738110 - DNA, 25 bp, Artificial sequence
  Synthetic oligonucleotide
cacagaaccaaaccttaaactcgaa

SEQ ID NO: 738111 - DNA, 25 bp, Artificial sequence
  Synthetic oligonucleotide
ttgatggaagcctcgggcctaaaga

SEQ ID NO: 738112 - DNA, 25 bp, Artificial sequence
  Synthetic oligonucleotide
tgttttgatgagtcagcctctgcat

SEQ ID NO: 738113 - DNA, 25 bp, Artificial sequence
  Synthetic oligonucleotide
cggaaggagttatatgtagagacaa

SEQ ID NO: 738114 - DNA, 25 bp, Artificial sequence
  Synthetic oligonucleotide
gatggatccttacatcaactttgac

SEQ ID NO: 738115 - DNA, 25 bp, Artificial sequence
  Synthetic oligonucleotide
ggttctcagagctctactcagtcag

SEQ ID NO: 738116 - DNA, 25 bp, Artificial sequence
  Synthetic oligonucleotide
gaaggtagctcggagagcctcctga

SEQ ID NO: 738117 - DNA, 25 bp, Artificial sequence
  Synthetic oligonucleotide
gaaggtagctcgcagagcctcctga

SEQ ID NO: 738118 - DNA, 25 bp, Artificial sequence
  Synthetic oligonucleotide
ccaagcactgtttggaattgctgat

SEQ ID NO: 738119 - DNA, 25 bp, Artificial sequence
  Synthetic oligonucleotide
ccaagcactgttaggaattgctgat

SEQ ID NO: 738120 - DNA, 25 bp, Artificial sequence
  Synthetic oligonucleotide
acgagagttacttttgctatattcc

SEQ ID NO: 738121 - DNA, 25 bp, Artificial sequence
  Synthetic oligonucleotide
caactaagcgtgattgtgtgtatgt

SEQ ID NO: 738122 - DNA, 25 bp, Artificial sequence
  Synthetic oligonucleotide
ggttctcagagcactactcagtcag

SEQ ID NO: 738123 - DNA, 25 bp, Artificial sequence
  Synthetic oligonucleotide
ttgatggaagccacgggcctaaaga

SEQ ID NO: 738124 - DNA, 25 bp, Artificial sequence
  Synthetic oligonucleotide
cacagaaccaaagcttaaactcgaa

SEQ ID NO: 738125 - DNA, 25 bp, Artificial sequence
  Synthetic oligonucleotide
ggcctcgactcattctgttcttcag

SEQ ID NO: 738126 - DNA, 25 bp, Artificial sequence
  Synthetic oligonucleotide
ggcctcgactcaatctgttcttcag

SEQ ID NO: 738127 - DNA, 25 bp, Artificial sequence
  Synthetic oligonucleotide
cccttgtttactggtggttcagcct

SEQ ID NO: 738128 - DNA, 25 bp, Artificial sequence
  Synthetic oligonucleotide
cccttgtttactcgtggttcagcct

SEQ ID NO: 738129 - DNA, 25 bp, Artificial sequence
  Synthetic oligonucleotide
cagtctctgaactcaagattccatg

SEQ ID NO: 738130 - DNA, 25 bp, Artificial sequence
  Synthetic oligonucleotide
cagtctctgaacacaagattccatg

SEQ ID NO: 738131 - DNA, 25 bp, Artificial sequence
  Synthetic oligonucleotide
agactgggtcttctgtagggtattc

SEQ ID NO: 738132 - DNA, 25 bp, Artificial sequence
  Synthetic oligonucleotide
tactattgcgagacaaaaaagttgg

SEQ ID NO: 738133 - DNA, 25 bp, Artificial sequence
  Synthetic oligonucleotide
tatttctacagcgaaagagaccgaa

SEQ ID NO: 738134 - DNA, 25 bp, Artificial sequence
  Synthetic oligonucleotide
tatttctacagccaaagagaccgaa

SEQ ID NO: 738135 - DNA, 25 bp, Artificial sequence
  Synthetic oligonucleotide
atgattagaaatcgcatgcgtggga

SEQ ID NO: 738136 - DNA, 25 bp, Artificial sequence
  Synthetic oligonucleotide
caactaagcgtgtttgtgtgtatgt

SEQ ID NO: 738137 - DNA, 25 bp, Artificial sequence
  Synthetic oligonucleotide
tcacatgatcagattcattatcctg

SEQ ID NO: 738138 - DNA, 25 bp, Artificial sequence
  Synthetic oligonucleotide
atgattagaaatggcatgcgtggga

SEQ ID NO: 738139 - DNA, 25 bp, Artificial sequence
  Synthetic oligonucleotide
tactattgcgagtcaaaaaagttgg

SEQ ID NO: 738140 - DNA, 25 bp, Artificial sequence
  Synthetic oligonucleotide
tattggaaagccaccggcaaagaca

SEQ ID NO: 738141 - DNA, 25 bp, Artificial sequence
  Synthetic oligonucleotide
tttaaaagctaattgtttctaaaca

SEQ ID NO: 738142 - DNA, 25 bp, Artificial sequence
  Synthetic oligonucleotide
acgagagttactattgctatattcc

SEQ ID NO: 738143 - DNA, 25 bp, Artificial sequence
  Synthetic oligonucleotide
ggaaacgcacttcccctagagacaa

SEQ ID NO: 738144 - DNA, 25 bp, Artificial sequence
  Synthetic oligonucleotide
tttaaaagctaaatgtttctaaaca

SEQ ID NO: 738145 - DNA, 25 bp, Artificial sequence
  Synthetic oligonucleotide
tcaataatatccaacaatttttttg

SEQ ID NO: 738146 - DNA, 25 bp, Artificial sequence
  Synthetic oligonucleotide
tcaataatatcctacaatttttttg

SEQ ID NO: 738147 - DNA, 25 bp, Artificial sequence
  Synthetic oligonucleotide
tcacatgatcagtttcattatcctg

SEQ ID NO: 738148 - DNA, 25 bp, Artificial sequence
  Synthetic oligonucleotide
aaaccgattgggacatgcacgaatt

SEQ ID NO: 738149 - DNA, 25 bp, Artificial sequence
  Synthetic oligonucleotide
cgagtaatatacgtgtttatgtgtt

SEQ ID NO: 738150 - DNA, 25 bp, Artificial sequence
  Synthetic oligonucleotide
gatcgtcagttaatctcttcttagc

SEQ ID NO: 738151 - DNA, 25 bp, Artificial sequence
  Synthetic oligonucleotide
gatcgtcagttattctcttcttagc

SEQ ID NO: 738152 - DNA, 25 bp, Artificial sequence
  Synthetic oligonucleotide
gctctccaaaggtatacacagttaa

SEQ ID NO: 738153 - DNA, 25 bp, Artificial sequence
  Synthetic oligonucleotide
gctctccaaaggaatacacagttaa

SEQ ID NO: 738154 - DNA, 25 bp, Artificial sequence
  Synthetic oligonucleotide
ggatctcatcatcctcccaatcatt

SEQ ID NO: 738155 - DNA, 25 bp, Artificial sequence
  Synthetic oligonucleotide
ggctgagaactaaccgagcaacggc

SEQ ID NO: 738156 - DNA, 25 bp, Artificial sequence
  Synthetic oligonucleotide
aaaccgattgggtcatgcacgaatt

SEQ ID NO: 738157 - DNA, 25 bp, Artificial sequence
  Synthetic oligonucleotide
ggctgagaactatccgagcaacggc

SEQ ID NO: 738158 - DNA, 25 bp, Artificial sequence
  Synthetic oligonucleotide
tggttttctatctaggtcgagctcc

SEQ ID NO: 738159 - DNA, 25 bp, Artificial sequence
  Synthetic oligonucleotide
tggttttctatcaaggtcgagctcc

SEQ ID NO: 738160 - DNA, 25 bp, Artificial sequence
  Synthetic oligonucleotide
tctaagaaagggaaagctagttggg

SEQ ID NO: 738161 - DNA, 25 bp, Artificial sequence
  Synthetic oligonucleotide
tctaagaaagggtaagctagttggg

SEQ ID NO: 738162 - DNA, 25 bp, Artificial sequence
  Synthetic oligonucleotide
tattggaaagcctccggcaaagaca

SEQ ID NO: 738163 - DNA, 25 bp, Artificial sequence
  Synthetic oligonucleotide
cgagtaatatacctgtttatgtgtt

SEQ ID NO: 738164 - DNA, 25 bp, Artificial sequence
  Synthetic oligonucleotide
ggatctcatcatgctcccaatcatt

SEQ ID NO: 738165 - DNA, 25 bp, Artificial sequence
  Synthetic oligonucleotide
gagaattgcaccttcaacatttggg

SEQ ID NO: 738166 - DNA, 25 bp, Artificial sequence
  Synthetic oligonucleotide
aaggcacctctcgtctacggctatg

SEQ ID NO: 738167 - DNA, 25 bp, Artificial sequence
  Synthetic oligonucleotide
ggaaacgcacttgccctagagacaa

SEQ ID NO: 738168 - DNA, 25 bp, Artificial sequence
  Synthetic oligonucleotide
tatcatcaaataagcagaaactgtc

SEQ ID NO: 738169 - DNA, 25 bp, Artificial sequence
  Synthetic oligonucleotide
aaggcacctctcctctacggctatg

SEQ ID NO: 738170 - DNA, 25 bp, Artificial sequence
  Synthetic oligonucleotide
tctccacagattcctagattcctgt

SEQ ID NO: 738171 - DNA, 25 bp, Artificial sequence
  Synthetic oligonucleotide
gctgacaagcgaagagattaacaga

SEQ ID NO: 738172 - DNA, 25 bp, Artificial sequence
  Synthetic oligonucleotide
gagaattgcaccatcaacatttggg

SEQ ID NO: 738173 - DNA, 25 bp, Artificial sequence
  Synthetic oligonucleotide
tcaggacgcttaccatctgtgggct

SEQ ID NO: 738174 - DNA, 25 bp, Artificial sequence
  Synthetic oligonucleotide
aagtctgcaaaacctttgacgctgc

SEQ ID NO: 738175 - DNA, 25 bp, Artificial sequence
  Synthetic oligonucleotide
aagtctgcaaaagctttgacgctgc

SEQ ID NO: 738176 - DNA, 25 bp, Artificial sequence
  Synthetic oligonucleotide
gggacacactcaatagggtacctat

SEQ ID NO: 738177 - DNA, 25 bp, Artificial sequence
  Synthetic oligonucleotide
gggacacactcattagggtacctat

SEQ ID NO: 738178 - DNA, 25 bp, Artificial sequence
  Synthetic oligonucleotide
aatgtttttgttactctgttttgag

SEQ ID NO: 738179 - DNA, 25 bp, Artificial sequence
  Synthetic oligonucleotide
aatgtttttgtttctctgttttgag

SEQ ID NO: 738180 - DNA, 25 bp, Artificial sequence
  Synthetic oligonucleotide
tctccacagattgctagattcctgt

SEQ ID NO: 738181 - DNA, 25 bp, Artificial sequence
  Synthetic oligonucleotide
tcactcgatagcatttggaggccgg

SEQ ID NO: 738182 - DNA, 25 bp, Artificial sequence
  Synthetic oligonucleotide
tgcttactttcgtagatgttgccaa

SEQ ID NO: 738183 - DNA, 25 bp, Artificial sequence
  Synthetic oligonucleotide
cgatttatataatgttatggattgg

SEQ ID NO: 738184 - DNA, 25 bp, Artificial sequence
  Synthetic oligonucleotide
cgttatgagattgattaaacttttc

SEQ ID NO: 738185 - DNA, 25 bp, Artificial sequence
  Synthetic oligonucleotide
tccacctttcacaaaaaaaatcaag

SEQ ID NO: 738186 - DNA, 25 bp, Artificial sequence
  Synthetic oligonucleotide
tccacctttcactaaaaaaatcaag

SEQ ID NO: 738187 - DNA, 25 bp, Artificial sequence
  Synthetic oligonucleotide
gctgacaagcgatgagattaacaga

SEQ ID NO: 738188 - DNA, 25 bp, Artificial sequence
  Synthetic oligonucleotide
cactgttggcattgtctggagtaga

SEQ ID NO: 738189 - DNA, 25 bp, Artificial sequence
  Synthetic oligonucleotide
tcatcggccgatagagttcacgagg

SEQ ID NO: 738190 - DNA, 25 bp, Artificial sequence
  Synthetic oligonucleotide
tcactcgatagcttttggaggccgg

SEQ ID NO: 738191 - DNA, 25 bp, Artificial sequence
  Synthetic oligonucleotide
tttgaacatctcatcagatattttg

SEQ ID NO: 738192 - DNA, 25 bp, Artificial sequence
  Synthetic oligonucleotide
tttgaacatctcttcagatattttg

SEQ ID NO: 738193 - DNA, 25 bp, Artificial sequence
  Synthetic oligonucleotide
gggagagaactaacaaggcctgagc

SEQ ID NO: 738194 - DNA, 25 bp, Artificial sequence
  Synthetic oligonucleotide
gggagagaactatcaaggcctgagc

SEQ ID NO: 738195 - DNA, 25 bp, Artificial sequence
  Synthetic oligonucleotide
tcaggacgcttagcatctgtgggct

SEQ ID NO: 738196 - DNA, 25 bp, Artificial sequence
  Synthetic oligonucleotide
cactgttggcatagtctggagtaga

SEQ ID NO: 738197 - DNA, 25 bp, Artificial sequence
  Synthetic oligonucleotide
gctagacatacaaatatttcatcgt

SEQ ID NO: 738198 - DNA, 25 bp, Artificial sequence
  Synthetic oligonucleotide
cctgaaacagaatttaaataaatca

SEQ ID NO: 738199 - DNA, 25 bp, Artificial sequence
  Synthetic oligonucleotide
gataggtgattgaatagccaaggca

SEQ ID NO: 738200 - DNA, 25 bp, Artificial sequence
  Synthetic oligonucleotide
gataggtgattgtatagccaaggca

SEQ ID NO: 738201 - DNA, 25 bp, Artificial sequence
  Synthetic oligonucleotide
gataatatgaaacatcactacctgt

SEQ ID NO: 738202 - DNA, 25 bp, Artificial sequence
  Synthetic oligonucleotide
gataatatgaaagatcactacctgt

SEQ ID NO: 738203 - DNA, 25 bp, Artificial sequence
  Synthetic oligonucleotide
tagtcattttacttgattctagtag

SEQ ID NO: 738204 - DNA, 25 bp, Artificial sequence
  Synthetic oligonucleotide
gtttcaaggtattaaggacctctag

SEQ ID NO: 738205 - DNA, 25 bp, Artificial sequence
  Synthetic oligonucleotide
tcggaacaaaaatcctcagaataac

SEQ ID NO: 738206 - DNA, 25 bp, Artificial sequence
  Synthetic oligonucleotide
gctagacatacatatatttcatcgt

SEQ ID NO: 738207 - DNA, 25 bp, Artificial sequence
  Synthetic oligonucleotide
cccacggtagattcatgtaaaatac

SEQ ID NO: 738208 - DNA, 25 bp, Artificial sequence
  Synthetic oligonucleotide
cccacggtagatacatgtaaaatac

SEQ ID NO: 738209 - DNA, 25 bp, Artificial sequence
  Synthetic oligonucleotide
tgtctgattgtagaaacatttcctc

SEQ ID NO: 738210 - DNA, 25 bp, Artificial sequence
  Synthetic oligonucleotide
tgtctgattgtacaaacatttcctc

SEQ ID NO: 738211 - DNA, 25 bp, Artificial sequence
  Synthetic oligonucleotide
gattggaacaatacttcggggggaa

SEQ ID NO: 738212 - DNA, 25 bp, Artificial sequence
  Synthetic oligonucleotide
gtttcaaggtataaaggacctctag

SEQ ID NO: 738213 - DNA, 25 bp, Artificial sequence
  Synthetic oligonucleotide
tgcttactttcgaagatgttgccaa

SEQ ID NO: 738214 - DNA, 25 bp, Artificial sequence
  Synthetic oligonucleotide
gattggaacaattcttcggggggaa

SEQ ID NO: 738215 - DNA, 25 bp, Artificial sequence
  Synthetic oligonucleotide
tcatcggccgattgagttcacgagg

SEQ ID NO: 738216 - DNA, 25 bp, Artificial sequence
  Synthetic oligonucleotide
tttaggaagatcacatgatattccg

SEQ ID NO: 738217 - DNA, 25 bp, Artificial sequence
  Synthetic oligonucleotide
tttaggaagatctcatgatattccg

SEQ ID NO: 738218 - DNA, 25 bp, Artificial sequence
  Synthetic oligonucleotide
actgcgctggctatcatttctcaag

SEQ ID NO: 738219 - DNA, 25 bp, Artificial sequence
  Synthetic oligonucleotide
actgcgctggctttcatttctcaag

SEQ ID NO: 738220 - DNA, 25 bp, Artificial sequence
  Synthetic oligonucleotide
cctgaaacagaaattaaataaatca

SEQ ID NO: 738221 - DNA, 25 bp, Artificial sequence
  Synthetic oligonucleotide
tcaaaaagcactgcgactggcactt

SEQ ID NO: 738222 - DNA, 25 bp, Artificial sequence
  Synthetic oligonucleotide
tcggaacaaaaaacctcagaataac

SEQ ID NO: 738223 - DNA, 25 bp, Artificial sequence
  Synthetic oligonucleotide
tatcatcaaatatgcagaaactgtc

SEQ ID NO: 738224 - DNA, 25 bp, Artificial sequence
  Synthetic oligonucleotide
gcacatagattcttcaacgcatagg

SEQ ID NO: 738225 - DNA, 25 bp, Artificial sequence
  Synthetic oligonucleotide
gcacatagattcatcaacgcatagg

SEQ ID NO: 738226 - DNA, 25 bp, Artificial sequence
  Synthetic oligonucleotide
cacggtaggaacttatattgaatcc

SEQ ID NO: 738227 - DNA, 25 bp, Artificial sequence
  Synthetic oligonucleotide
cacggtaggaacatatattgaatcc

SEQ ID NO: 738228 - DNA, 25 bp, Artificial sequence
  Synthetic oligonucleotide
tagtcattttacatgattctagtag

SEQ ID NO: 738229 - DNA, 25 bp, Artificial sequence
  Synthetic oligonucleotide
tcaaaaagcactccgactggcactt

SEQ ID NO: 738230 - DNA, 25 bp, Artificial sequence
  Synthetic oligonucleotide
tgttttggatagtgtacgtaattaa

SEQ ID NO: 738231 - DNA, 25 bp, Artificial sequence
  Synthetic oligonucleotide
tgtttcatggcacccatgccactgt

SEQ ID NO: 738232 - DNA, 25 bp, Artificial sequence
  Synthetic oligonucleotide
tgtttcatggcagccatgccactgt

SEQ ID NO: 738233 - DNA, 25 bp, Artificial sequence
  Synthetic oligonucleotide
cagagagcataatgcgttatcaaga

SEQ ID NO: 738234 - DNA, 25 bp, Artificial sequence
  Synthetic oligonucleotide
cagagagcataaagcgttatcaaga

SEQ ID NO: 738235 - DNA, 25 bp, Artificial sequence
  Synthetic oligonucleotide
accaattgactaaaccattttaaca

SEQ ID NO: 738236 - DNA, 25 bp, Artificial sequence
  Synthetic oligonucleotide
accaattgactataccattttaaca

SEQ ID NO: 738237 - DNA, 25 bp, Artificial sequence
  Synthetic oligonucleotide
tcttcttatgttatgtaacatgcaa

SEQ ID NO: 738238 - DNA, 25 bp, Artificial sequence
  Synthetic oligonucleotide
tcttcttatgttttgtaacatgcaa

SEQ ID NO: 738239 - DNA, 25 bp, Artificial sequence
  Synthetic oligonucleotide
gatatatatcatagagaatgtagac

SEQ ID NO: 738240 - DNA, 25 bp, Artificial sequence
  Synthetic oligonucleotide
gatatatatcattgagaatgtagac

SEQ ID NO: 738241 - DNA, 25 bp, Artificial sequence
  Synthetic oligonucleotide
tattatctatgtgtatcctcagcta

SEQ ID NO: 738242 - DNA, 25 bp, Artificial sequence
  Synthetic oligonucleotide
tattatctatgtctatcctcagcta

SEQ ID NO: 738243 - DNA, 25 bp, Artificial sequence
  Synthetic oligonucleotide
ctaggcaaaaatatgtgagtctgtt

SEQ ID NO: 738244 - DNA, 25 bp, Artificial sequence
  Synthetic oligonucleotide
gagatgaaggaaagtagtataagca

SEQ ID NO: 738245 - DNA, 25 bp, Artificial sequence
  Synthetic oligonucleotide
gcaattactactaaaaccaagggtc

SEQ ID NO: 738246 - DNA, 25 bp, Artificial sequence
  Synthetic oligonucleotide
gagatgaaggaatgtagtataagca

SEQ ID NO: 738247 - DNA, 25 bp, Artificial sequence
  Synthetic oligonucleotide
cctagaaaaaaaaaggatcaaatca

SEQ ID NO: 738248 - DNA, 25 bp, Artificial sequence
  Synthetic oligonucleotide
cctagaaaaaaataggatcaaatca

SEQ ID NO: 738249 - DNA, 25 bp, Artificial sequence
  Synthetic oligonucleotide
tatctctcttttgctcttaaccatc

SEQ ID NO: 738250 - DNA, 25 bp, Artificial sequence
  Synthetic oligonucleotide
tatctctcttttcctcttaaccatc

SEQ ID NO: 738251 - DNA, 25 bp, Artificial sequence
  Synthetic oligonucleotide
ctaggcaaaaatttgtgagtctgtt

SEQ ID NO: 738252 - DNA, 25 bp, Artificial sequence
  Synthetic oligonucleotide
gacacacccaaatgatcccaataat

SEQ ID NO: 738253 - DNA, 25 bp, Artificial sequence
  Synthetic oligonucleotide
tgttttggatagagtacgtaattaa

SEQ ID NO: 738254 - DNA, 25 bp, Artificial sequence
  Synthetic oligonucleotide
gcaattactacttaaaccaagggtc

SEQ ID NO: 738255 - DNA, 25 bp, Artificial sequence
  Synthetic oligonucleotide
aaaaatgatataaatagaagttgac

SEQ ID NO: 738256 - DNA, 25 bp, Artificial sequence
  Synthetic oligonucleotide
aaaaatgatatatatagaagttgac

SEQ ID NO: 738257 - DNA, 25 bp, Artificial sequence
  Synthetic oligonucleotide
tggaaattaaattctaacatatgat

SEQ ID NO: 738258 - DNA, 25 bp, Artificial sequence
  Synthetic oligonucleotide
tggaaattaaatactaacatatgat

SEQ ID NO: 738259 - DNA, 25 bp, Artificial sequence
  Synthetic oligonucleotide
tcaaaacattaaaatactaaaagaa

SEQ ID NO: 738260 - DNA, 25 bp, Artificial sequence
  Synthetic oligonucleotide
gacacacccaaaagatcccaataat

SEQ ID NO: 738261 - DNA, 25 bp, Artificial sequence
  Synthetic oligonucleotide
ccaaaatccatgaataaaaatgacc

SEQ ID NO: 738262 - DNA, 25 bp, Artificial sequence
  Synthetic oligonucleotide
tggaagctagtaatacattctttaa

SEQ ID NO: 738263 - DNA, 25 bp, Artificial sequence
  Synthetic oligonucleotide
gtctttgggccaggcgggcctttca

SEQ ID NO: 738264 - DNA, 25 bp, Artificial sequence
  Synthetic oligonucleotide
aatcgtggaattaagtatagggcaa

SEQ ID NO: 738265 - DNA, 25 bp, Artificial sequence
  Synthetic oligonucleotide
aatcgtggaatttagtatagggcaa

SEQ ID NO: 738266 - DNA, 25 bp, Artificial sequence
  Synthetic oligonucleotide
taattagcaaaacttattcaccgat

SEQ ID NO: 738267 - DNA, 25 bp, Artificial sequence
  Synthetic oligonucleotide
gctgttcacatgaattattctcatt

SEQ ID NO: 738268 - DNA, 25 bp, Artificial sequence
  Synthetic oligonucleotide
ccaaaatccatgtataaaaatgacc

SEQ ID NO: 738269 - DNA, 25 bp, Artificial sequence
  Synthetic oligonucleotide
gctgttcacatgtattattctcatt

SEQ ID NO: 738270 - DNA, 25 bp, Artificial sequence
  Synthetic oligonucleotide
tccacaattaatcggcaagtttgag

SEQ ID NO: 738271 - DNA, 25 bp, Artificial sequence
  Synthetic oligonucleotide
tccacaattaatgggcaagtttgag

SEQ ID NO: 738272 - DNA, 25 bp, Artificial sequence
  Synthetic oligonucleotide
cgttatgagattcattaaacttttc

SEQ ID NO: 738273 - DNA, 25 bp, Artificial sequence
  Synthetic oligonucleotide
gttttatacacgtggcacagcaatg

SEQ ID NO: 738274 - DNA, 25 bp, Artificial sequence
  Synthetic oligonucleotide
tacacatatatagatactttataag

SEQ ID NO: 738275 - DNA, 25 bp, Artificial sequence
  Synthetic oligonucleotide
gatctgaggtaaaggcgaaaacgac

SEQ ID NO: 738276 - DNA, 25 bp, Artificial sequence
  Synthetic oligonucleotide
taattagcaaaagttattcaccgat

SEQ ID NO: 738277 - DNA, 25 bp, Artificial sequence
  Synthetic oligonucleotide
cataaacaataaacagaaaaaactg

SEQ ID NO: 738278 - DNA, 25 bp, Artificial sequence
  Synthetic oligonucleotide
gttttatacacgaggcacagcaatg

SEQ ID NO: 738279 - DNA, 25 bp, Artificial sequence
  Synthetic oligonucleotide
tcaaaacattaatatactaaaagaa

SEQ ID NO: 738280 - DNA, 25 bp, Artificial sequence
  Synthetic oligonucleotide
gaaataattaaaccattcagacacg

SEQ ID NO: 738281 - DNA, 25 bp, Artificial sequence
  Synthetic oligonucleotide
gaaataattaaagcattcagacacg

SEQ ID NO: 738282 - DNA, 25 bp, Artificial sequence
  Synthetic oligonucleotide
gtttcatagtataaactaatcctac

SEQ ID NO: 738283 - DNA, 25 bp, Artificial sequence
  Synthetic oligonucleotide
gtctttgggccacgcgggcctttca

SEQ ID NO: 738284 - DNA, 25 bp, Artificial sequence
  Synthetic oligonucleotide
cataaacaataatcagaaaaaactg

SEQ ID NO: 738285 - DNA, 25 bp, Artificial sequence
  Synthetic oligonucleotide
tggaagctagtattacattctttaa

SEQ ID NO: 738286 - DNA, 25 bp, Artificial sequence
  Synthetic oligonucleotide
cgtgtattttaatgacggagattac

SEQ ID NO: 738287 - DNA, 25 bp, Artificial sequence
  Synthetic oligonucleotide
cgtgtattttaaagacggagattac

SEQ ID NO: 738288 - DNA, 25 bp, Artificial sequence
  Synthetic oligonucleotide
gtgtctatgactacgtcgacaaatg

SEQ ID NO: 738289 - DNA, 25 bp, Artificial sequence
  Synthetic oligonucleotide
gtgtctatgacttcgtcgacaaatg

SEQ ID NO: 738290 - DNA, 25 bp, Artificial sequence
  Synthetic oligonucleotide
tcggattatatgttgtttttaaaac

SEQ ID NO: 738291 - DNA, 25 bp, Artificial sequence
  Synthetic oligonucleotide
tcggattatatgatgtttttaaaac

SEQ ID NO: 738292 - DNA, 25 bp, Artificial sequence
  Synthetic oligonucleotide
gtttcatagtattaactaatcctac

SEQ ID NO: 738293 - DNA, 25 bp, Artificial sequence
  Synthetic oligonucleotide
ggtttatagcctatagagtgtgaca

SEQ ID NO: 738294 - DNA, 25 bp, Artificial sequence
  Synthetic oligonucleotide
tatacgagaagtagacactcttggc

SEQ ID NO: 738295 - DNA, 25 bp, Artificial sequence
  Synthetic oligonucleotide
gggtcctgattacttttcaaatcaa

SEQ ID NO: 738296 - DNA, 25 bp, Artificial sequence
  Synthetic oligonucleotide
gggtcctgattagttttcaaatcaa

SEQ ID NO: 738297 - DNA, 25 bp, Artificial sequence
  Synthetic oligonucleotide
tcttattctctcctttgcttacgcc

SEQ ID NO: 738298 - DNA, 25 bp, Artificial sequence
  Synthetic oligonucleotide
tcttattctctcgtttgcttacgcc

SEQ ID NO: 738299 - DNA, 25 bp, Artificial sequence
  Synthetic oligonucleotide
gacccttcaactacataataattat

SEQ ID NO: 738300 - DNA, 25 bp, Artificial sequence
  Synthetic oligonucleotide
aatgtaaaattcgttgggtttgatc

SEQ ID NO: 738301 - DNA, 25 bp, Artificial sequence
  Synthetic oligonucleotide
tagtcgtcattcttttgatcaaaga

SEQ ID NO: 738302 - DNA, 25 bp, Artificial sequence
  Synthetic oligonucleotide
ggtttatagcctttagagtgtgaca

SEQ ID NO: 738303 - DNA, 25 bp, Artificial sequence
  Synthetic oligonucleotide
taagagtaacgaggaaaaagtcaat

SEQ ID NO: 738304 - DNA, 25 bp, Artificial sequence
  Synthetic oligonucleotide
taagagtaacgacgaaaaagtcaat

SEQ ID NO: 738305 - DNA, 25 bp, Artificial sequence
  Synthetic oligonucleotide
tcaaccaaattcatgaaaaaaaagc

SEQ ID NO: 738306 - DNA, 25 bp, Artificial sequence
  Synthetic oligonucleotide
tcaaccaaattcttgaaaaaaaagc

SEQ ID NO: 738307 - DNA, 25 bp, Artificial sequence
  Synthetic oligonucleotide
tatacgagaagttgacactcttggc

SEQ ID NO: 738308 - DNA, 25 bp, Artificial sequence
  Synthetic oligonucleotide
aatgtaaaattccttgggtttgatc

SEQ ID NO: 738309 - DNA, 25 bp, Artificial sequence
  Synthetic oligonucleotide
tcgttgttttggatgaataatcaca

SEQ ID NO: 738310 - DNA, 25 bp, Artificial sequence
  Synthetic oligonucleotide
gatctgaggtaatggcgaaaacgac

SEQ ID NO: 738311 - DNA, 25 bp, Artificial sequence
  Synthetic oligonucleotide
gcaaagttgcctgcgggattcagat

SEQ ID NO: 738312 - DNA, 25 bp, Artificial sequence
  Synthetic oligonucleotide
tgaacatggcatatcttataaagaa

SEQ ID NO: 738313 - DNA, 25 bp, Artificial sequence
  Synthetic oligonucleotide
tatactattaatcgtaaatcctaaa

SEQ ID NO: 738314 - DNA, 25 bp, Artificial sequence
  Synthetic oligonucleotide
tatactattaatggtaaatcctaaa

SEQ ID NO: 738315 - DNA, 25 bp, Artificial sequence
  Synthetic oligonucleotide
gacccttcaacttcataataattat

SEQ ID NO: 738316 - DNA, 25 bp, Artificial sequence
  Synthetic oligonucleotide
gctttagttcaaaccctcacggatg

SEQ ID NO: 738317 - DNA, 25 bp, Artificial sequence
  Synthetic oligonucleotide
tgaacatggcatttcttataaagaa

SEQ ID NO: 738318 - DNA, 25 bp, Artificial sequence
  Synthetic oligonucleotide
tcgttgttttggttgaataatcaca

SEQ ID NO: 738319 - DNA, 25 bp, Artificial sequence
  Synthetic oligonucleotide
tcaaaatcctacacatttacacgcg

SEQ ID NO: 738320 - DNA, 25 bp, Artificial sequence
  Synthetic oligonucleotide
tcaaaatcctactcatttacacgcg

SEQ ID NO: 738321 - DNA, 25 bp, Artificial sequence
  Synthetic oligonucleotide
tctttatttcaaacaaaattccaca

SEQ ID NO: 738322 - DNA, 25 bp, Artificial sequence
  Synthetic oligonucleotide
tctttatttcaatcaaaattccaca

SEQ ID NO: 738323 - DNA, 25 bp, Artificial sequence
  Synthetic oligonucleotide
tagtcgtcattcatttgatcaaaga

SEQ ID NO: 738324 - DNA, 25 bp, Artificial sequence
  Synthetic oligonucleotide
gctttagttcaatccctcacggatg

SEQ ID NO: 738325 - DNA, 25 bp, Artificial sequence
  Synthetic oligonucleotide
gacaacagtatcattattgatccat

SEQ ID NO: 738326 - DNA, 25 bp, Artificial sequence
  Synthetic oligonucleotide
gcaaagttgcctccgggattcagat

SEQ ID NO: 738327 - DNA, 25 bp, Artificial sequence
  Synthetic oligonucleotide
gacgatgagcttgtctgcgattact

SEQ ID NO: 738328 - DNA, 25 bp, Artificial sequence
  Synthetic oligonucleotide
gatcgcttcacattaatcatcgacc

SEQ ID NO: 738329 - DNA, 25 bp, Artificial sequence
  Synthetic oligonucleotide
gatcgcttcacaataatcatcgacc

SEQ ID NO: 738330 - DNA, 25 bp, Artificial sequence
  Synthetic oligonucleotide
tgatccaagtcgatctcaacaagtg

SEQ ID NO: 738331 - DNA, 25 bp, Artificial sequence
  Synthetic oligonucleotide
tgatccaagtcgttctcaacaagtg

SEQ ID NO: 738332 - DNA, 25 bp, Artificial sequence
  Synthetic oligonucleotide
cgtaataatatgaaattaattcgag

SEQ ID NO: 738333 - DNA, 25 bp, Artificial sequence
  Synthetic oligonucleotide
gggacatcccaagtacgttttcatt

SEQ ID NO: 738334 - DNA, 25 bp, Artificial sequence
  Synthetic oligonucleotide
gacgatgagcttctctgcgattact

SEQ ID NO: 738335 - DNA, 25 bp, Artificial sequence
  Synthetic oligonucleotide
gacaacagtatctttattgatccat

SEQ ID NO: 738336 - DNA, 25 bp, Artificial sequence
  Synthetic oligonucleotide
gttttactttgaaatggttggtcca

SEQ ID NO: 738337 - DNA, 25 bp, Artificial sequence
  Synthetic oligonucleotide
gttttactttgatatggttggtcca

SEQ ID NO: 738338 - DNA, 25 bp, Artificial sequence
  Synthetic oligonucleotide
tatgtcatgatcttctttcgtgttc

SEQ ID NO: 738339 - DNA, 25 bp, Artificial sequence
  Synthetic oligonucleotide
tatgtcatgatcatctttcgtgttc

SEQ ID NO: 738340 - DNA, 25 bp, Artificial sequence
  Synthetic oligonucleotide
cgatttatataaagttatggattgg

SEQ ID NO: 738341 - DNA, 25 bp, Artificial sequence
  Synthetic oligonucleotide
cgtaataatatgtaattaattcgag

SEQ ID NO: 738342 - DNA, 25 bp, Artificial sequence
  Synthetic oligonucleotide
gggacatcccaactacgttttcatt

SEQ ID NO: 738343 - DNA, 25 bp, Artificial sequence
  Synthetic oligonucleotide
tctagaaacaaaactttagaagtta

SEQ ID NO: 738344 - DNA, 25 bp, Artificial sequence
  Synthetic oligonucleotide
tacacatatatacatactttataag

SEQ ID NO: 738345 - DNA, 25 bp, Artificial sequence
  Synthetic oligonucleotide
gatcagatgattacaatttataaga

SEQ ID NO: 738346 - DNA, 25 bp, Artificial sequence
  Synthetic oligonucleotide
caaaaaccttattcaaacatataac

SEQ ID NO: 738347 - DNA, 25 bp, Artificial sequence
  Synthetic oligonucleotide
caaaaaccttatacaaacatataac

SEQ ID NO: 738348 - DNA, 25 bp, Artificial sequence
  Synthetic oligonucleotide
gcatccagtttaaacaatgtagtct

SEQ ID NO: 738349 - DNA, 25 bp, Artificial sequence
  Synthetic oligonucleotide
gcatccagtttatacaatgtagtct

SEQ ID NO: 738350 - DNA, 25 bp, Artificial sequence
  Synthetic oligonucleotide
aactttaagatgatgatgtcacctc

SEQ ID NO: 738351 - DNA, 25 bp, Artificial sequence
  Synthetic oligonucleotide
aactttaagatgttgatgtcacctc

SEQ ID NO: 738352 - DNA, 25 bp, Artificial sequence
  Synthetic oligonucleotide
catatctactaaaacaaaagttgga

SEQ ID NO: 738353 - DNA, 25 bp, Artificial sequence
  Synthetic oligonucleotide
catatctactaatacaaaagttgga

SEQ ID NO: 738354 - DNA, 25 bp, Artificial sequence
  Synthetic oligonucleotide
tctagaaacaaatctttagaagtta

SEQ ID NO: 738355 - DNA, 25 bp, Artificial sequence
  Synthetic oligonucleotide
gatcagatgatttcaatttataaga

SEQ ID NO: 738356 - DNA, 25 bp, Artificial sequence
  Synthetic oligonucleotide
gcgttagattagatatctgtcgcaa

SEQ ID NO: 738357 - DNA, 25 bp, Artificial sequence
  Synthetic oligonucleotide
tgatggatttcttgttggtggtgcc

SEQ ID NO: 738358 - DNA, 25 bp, Artificial sequence
  Synthetic oligonucleotide
gaggcaacagtggagagcttgccaa

SEQ ID NO: 738359 - DNA, 25 bp, Artificial sequence
  Synthetic oligonucleotide
gaggcaacagtgcagagcttgccaa

SEQ ID NO: 738360 - DNA, 25 bp, Artificial sequence
  Synthetic oligonucleotide
gattattgccttctcaattgccagg

SEQ ID NO: 738361 - DNA, 25 bp, Artificial sequence
  Synthetic oligonucleotide
gattattgccttgtcaattgccagg

SEQ ID NO: 738362 - DNA, 25 bp, Artificial sequence
  Synthetic oligonucleotide
gcgttagattagttatctgtcgcaa

SEQ ID NO: 738363 - DNA, 25 bp, Artificial sequence
  Synthetic oligonucleotide
ggaagttgcttcgaaaacgagaatc

SEQ ID NO: 738364 - DNA, 25 bp, Artificial sequence
  Synthetic oligonucleotide
ggaagttgcttccaaaacgagaatc

SEQ ID NO: 738365 - DNA, 25 bp, Artificial sequence
  Synthetic oligonucleotide
tagctgtccgcgcttggctaaagaa

SEQ ID NO: 738366 - DNA, 25 bp, Artificial sequence
  Synthetic oligonucleotide
tagctgtccgcggttggctaaagaa

SEQ ID NO: 738367 - DNA, 25 bp, Artificial sequence
  Synthetic oligonucleotide
taaagttgcatctcctcagcaagca

SEQ ID NO: 738368 - DNA, 25 bp, Artificial sequence
  Synthetic oligonucleotide
taaagttgcatcacctcagcaagca

SEQ ID NO: 738369 - DNA, 25 bp, Artificial sequence
  Synthetic oligonucleotide
gtcacgtcgaagaaagttgctgctt

SEQ ID NO: 738370 - DNA, 25 bp, Artificial sequence
  Synthetic oligonucleotide
gttgttgtgttcatacatcttcttc

SEQ ID NO: 738371 - DNA, 25 bp, Artificial sequence
  Synthetic oligonucleotide
aaccatagtttatcgggaagaaagc

SEQ ID NO: 738372 - DNA, 25 bp, Artificial sequence
  Synthetic oligonucleotide
gttgttgtgttcttacatcttcttc

SEQ ID NO: 738373 - DNA, 25 bp, Artificial sequence
  Synthetic oligonucleotide
gatgagaaataatagggaggttagc

SEQ ID NO: 738374 - DNA, 25 bp, Artificial sequence
  Synthetic oligonucleotide
tcagtaacggaattcgctagtctcc

SEQ ID NO: 738375 - DNA, 25 bp, Artificial sequence
  Synthetic oligonucleotide
gatgagaaataaaagggaggttagc

SEQ ID NO: 738376 - DNA, 25 bp, Artificial sequence
  Synthetic oligonucleotide
gtcacgtcgaagtaagttgctgctt

SEQ ID NO: 738377 - DNA, 25 bp, Artificial sequence
  Synthetic oligonucleotide
tgatggatttctagttggtggtgcc

SEQ ID NO: 738378 - DNA, 25 bp, Artificial sequence
  Synthetic oligonucleotide
ctctagggtcctcagtttgcaacca

SEQ ID NO: 738379 - DNA, 25 bp, Artificial sequence
  Synthetic oligonucleotide
ctctagggtcctgagtttgcaacca

SEQ ID NO: 738380 - DNA, 25 bp, Artificial sequence
  Synthetic oligonucleotide
tagaagtaaagctgctcacactcac

SEQ ID NO: 738381 - DNA, 25 bp, Artificial sequence
  Synthetic oligonucleotide
tagaagtaaagcagctcacactcac

SEQ ID NO: 738382 - DNA, 25 bp, Artificial sequence
  Synthetic oligonucleotide
taaagtttagacctttatggatatg

SEQ ID NO: 738383 - DNA, 25 bp, Artificial sequence
  Synthetic oligonucleotide
taaagtttagacgtttatggatatg

SEQ ID NO: 738384 - DNA, 25 bp, Artificial sequence
  Synthetic oligonucleotide
tcagtaacggaaatcgctagtctcc

SEQ ID NO: 738385 - DNA, 25 bp, Artificial sequence
  Synthetic oligonucleotide
aaccatagtttaacgggaagaaagc

SEQ ID NO: 738386 - DNA, 25 bp, Artificial sequence
  Synthetic oligonucleotide
tctaaagagtactatgctggaacaa

SEQ ID NO: 738387 - DNA, 25 bp, Artificial sequence
  Synthetic oligonucleotide
taataatggaaaacagaaagaaaaa

SEQ ID NO: 738388 - DNA, 25 bp, Artificial sequence
  Synthetic oligonucleotide
gtgtaatatatgaaccttgtctgaa

SEQ ID NO: 738389 - DNA, 25 bp, Artificial sequence
  Synthetic oligonucleotide
gtgtaatatatgtaccttgtctgaa

SEQ ID NO: 738390 - DNA, 25 bp, Artificial sequence
  Synthetic oligonucleotide
gcccgttttaccatacagcgtggaa

SEQ ID NO: 738391 - DNA, 25 bp, Artificial sequence
  Synthetic oligonucleotide
gcccgttttaccttacagcgtggaa

SEQ ID NO: 738392 - DNA, 25 bp, Artificial sequence
  Synthetic oligonucleotide
ccttggctgcaactgggtcattctt

SEQ ID NO: 738393 - DNA, 25 bp, Artificial sequence
  Synthetic oligonucleotide
ccttggctgcaagtgggtcattctt

SEQ ID NO: 738394 - DNA, 25 bp, Artificial sequence
  Synthetic oligonucleotide
gaacggagacatgtcatcggagaaa

SEQ ID NO: 738395 - DNA, 25 bp, Artificial sequence
  Synthetic oligonucleotide
gaacggagacatctcatcggagaaa

SEQ ID NO: 738396 - DNA, 25 bp, Artificial sequence
  Synthetic oligonucleotide
aaataaaacactttataagcactgg

SEQ ID NO: 738397 - DNA, 25 bp, Artificial sequence
  Synthetic oligonucleotide
aaataaaacactatataagcactgg

SEQ ID NO: 738398 - DNA, 25 bp, Artificial sequence
  Synthetic oligonucleotide
tgagtgagggtcttggagtgatagc

SEQ ID NO: 738399 - DNA, 25 bp, Artificial sequence
  Synthetic oligonucleotide
aagggttgtgaaaacatatttgctc

SEQ ID NO: 738400 - DNA, 25 bp, Artificial sequence
  Synthetic oligonucleotide
tgttgcatacgaccctgtatgggca

SEQ ID NO: 738401 - DNA, 25 bp, Artificial sequence
  Synthetic oligonucleotide
tgagtgagggtcatggagtgatagc

SEQ ID NO: 738402 - DNA, 25 bp, Artificial sequence
  Synthetic oligonucleotide
gcgttgcaactattccctccttatg

SEQ ID NO: 738403 - DNA, 25 bp, Artificial sequence
  Synthetic oligonucleotide
aaagctagaagagagggaagcaggc

SEQ ID NO: 738404 - DNA, 25 bp, Artificial sequence
  Synthetic oligonucleotide
aaagctagaagacagggaagcaggc

SEQ ID NO: 738405 - DNA, 25 bp, Artificial sequence
  Synthetic oligonucleotide
tttgcttcgcgcaactgaaggcgtt

SEQ ID NO: 738406 - DNA, 25 bp, Artificial sequence
  Synthetic oligonucleotide
tttgcttcgcgctactgaaggcgtt

SEQ ID NO: 738407 - DNA, 25 bp, Artificial sequence
  Synthetic oligonucleotide
tgtattttctttgattaccctctcc

SEQ ID NO: 738408 - DNA, 25 bp, Artificial sequence
  Synthetic oligonucleotide
tgtattttctttcattaccctctcc

SEQ ID NO: 738409 - DNA, 25 bp, Artificial sequence
  Synthetic oligonucleotide
tgtctgaactcaattaacagcagta

SEQ ID NO: 738410 - DNA, 25 bp, Artificial sequence
  Synthetic oligonucleotide
tgtctgaactcatttaacagcagta

SEQ ID NO: 738411 - DNA, 25 bp, Artificial sequence
  Synthetic oligonucleotide
ttttcagatgctctgcctagctggg

SEQ ID NO: 738412 - DNA, 25 bp, Artificial sequence
  Synthetic oligonucleotide
ttttcagatgctgtgcctagctggg

SEQ ID NO: 738413 - DNA, 25 bp, Artificial sequence
  Synthetic oligonucleotide
tgttgcatacgagcctgtatgggca

SEQ ID NO: 738414 - DNA, 25 bp, Artificial sequence
  Synthetic oligonucleotide
aagggttgtgaatacatatttgctc

SEQ ID NO: 738415 - DNA, 25 bp, Artificial sequence
  Synthetic oligonucleotide
tcatcgagtgatgcctcggtagacc

SEQ ID NO: 738416 - DNA, 25 bp, Artificial sequence
  Synthetic oligonucleotide
catgaggagaatatttatgacaaga

SEQ ID NO: 738417 - DNA, 25 bp, Artificial sequence
  Synthetic oligonucleotide
aaaccctaaatttcctcaagactga

SEQ ID NO: 738418 - DNA, 25 bp, Artificial sequence
  Synthetic oligonucleotide
ggaaactctttctaaacgccgaagc

SEQ ID NO: 738419 - DNA, 25 bp, Artificial sequence
  Synthetic oligonucleotide
ggaaactctttcaaaacgccgaagc

SEQ ID NO: 738420 - DNA, 25 bp, Artificial sequence
  Synthetic oligonucleotide
caactggaaggaccaaaacagctct

SEQ ID NO: 738421 - DNA, 25 bp, Artificial sequence
  Synthetic oligonucleotide
caactggaaggagcaaaacagctct

SEQ ID NO: 738422 - DNA, 25 bp, Artificial sequence
  Synthetic oligonucleotide
tcttgttctttgttttcccagacga

SEQ ID NO: 738423 - DNA, 25 bp, Artificial sequence
  Synthetic oligonucleotide
tcttgttctttgatttcccagacga

SEQ ID NO: 738424 - DNA, 25 bp, Artificial sequence
  Synthetic oligonucleotide
ggccaaagtagttccctgaagataa

SEQ ID NO: 738425 - DNA, 25 bp, Artificial sequence
  Synthetic oligonucleotide
ggccaaagtagtaccctgaagataa

SEQ ID NO: 738426 - DNA, 25 bp, Artificial sequence
  Synthetic oligonucleotide
tcaatcagattattcaatcacactg

SEQ ID NO: 738427 - DNA, 25 bp, Artificial sequence
  Synthetic oligonucleotide
tcaatcagattaatcaatcacactg

SEQ ID NO: 738428 - DNA, 25 bp, Artificial sequence
  Synthetic oligonucleotide
tctaaagagtacaatgctggaacaa

SEQ ID NO: 738429 - DNA, 25 bp, Artificial sequence
  Synthetic oligonucleotide
ggaagagtacaatgagagaagcgaa

SEQ ID NO: 738430 - DNA, 25 bp, Artificial sequence
  Synthetic oligonucleotide
catgaggagaatttttatgacaaga

SEQ ID NO: 738431 - DNA, 25 bp, Artificial sequence
  Synthetic oligonucleotide
tcatcgagtgatccctcggtagacc

SEQ ID NO: 738432 - DNA, 25 bp, Artificial sequence
  Synthetic oligonucleotide
tttggttttctgctaaaagaggaga

SEQ ID NO: 738433 - DNA, 25 bp, Artificial sequence
  Synthetic oligonucleotide
tttggttttctggtaaaagaggaga

SEQ ID NO: 738434 - DNA, 25 bp, Artificial sequence
  Synthetic oligonucleotide
tgtttaactgcagaaatgatgaacc

SEQ ID NO: 738435 - DNA, 25 bp, Artificial sequence
  Synthetic oligonucleotide
tgtttaactgcacaaatgatgaacc

SEQ ID NO: 738436 - DNA, 25 bp, Artificial sequence
  Synthetic oligonucleotide
gcgttgcaactaatccctccttatg

SEQ ID NO: 738437 - DNA, 25 bp, Artificial sequence
  Synthetic oligonucleotide
ccaatggtttacgttggtgagacgc

SEQ ID NO: 738438 - DNA, 25 bp, Artificial sequence
  Synthetic oligonucleotide
tgtatgcccatagaccgaggaggag

SEQ ID NO: 738439 - DNA, 25 bp, Artificial sequence
  Synthetic oligonucleotide
tgtatgcccatacaccgaggaggag

SEQ ID NO: 738440 - DNA, 25 bp, Artificial sequence
  Synthetic oligonucleotide
tccgagtgttaataggaaaacagat

SEQ ID NO: 738441 - DNA, 25 bp, Artificial sequence
  Synthetic oligonucleotide
tccgagtgttaaaaggaaaacagat

SEQ ID NO: 738442 - DNA, 25 bp, Artificial sequence
  Synthetic oligonucleotide
gagaagacctcctgattcaactacc

SEQ ID NO: 738443 - DNA, 25 bp, Artificial sequence
  Synthetic oligonucleotide
gagaagacctccagattcaactacc

SEQ ID NO: 738444 - DNA, 25 bp, Artificial sequence
  Synthetic oligonucleotide
ggaagagtacaaagagagaagcgaa

SEQ ID NO: 738445 - DNA, 25 bp, Artificial sequence
  Synthetic oligonucleotide
gaatcacaactcagtgtaagtcgca

SEQ ID NO: 738446 - DNA, 25 bp, Artificial sequence
  Synthetic oligonucleotide
tgagctctggttagacagagagaga

SEQ ID NO: 738447 - DNA, 25 bp, Artificial sequence
  Synthetic oligonucleotide
tgagctctggtttgacagagagaga

SEQ ID NO: 738448 - DNA, 25 bp, Artificial sequence
  Synthetic oligonucleotide
taaagatctttgaaactaagctgtg

SEQ ID NO: 738449 - DNA, 25 bp, Artificial sequence
  Synthetic oligonucleotide
taaagatctttgtaactaagctgtg

SEQ ID NO: 738450 - DNA, 25 bp, Artificial sequence
  Synthetic oligonucleotide
caatttgagtaaccttgactcacga

SEQ ID NO: 738451 - DNA, 25 bp, Artificial sequence
  Synthetic oligonucleotide
caatttgagtaagcttgactcacga

SEQ ID NO: 738452 - DNA, 25 bp, Artificial sequence
  Synthetic oligonucleotide
taatctaaatcatatctcaagccac

SEQ ID NO: 738453 - DNA, 25 bp, Artificial sequence
  Synthetic oligonucleotide
taatctaaatcaaatctcaagccac

SEQ ID NO: 738454 - DNA, 25 bp, Artificial sequence
  Synthetic oligonucleotide
gctcgatagtcctgacagagagata

SEQ ID NO: 738455 - DNA, 25 bp, Artificial sequence
  Synthetic oligonucleotide
gctcgatagtccagacagagagata

SEQ ID NO: 738456 - DNA, 25 bp, Artificial sequence
  Synthetic oligonucleotide
gattctcaaacataccacactccaa

SEQ ID NO: 738457 - DNA, 25 bp, Artificial sequence
  Synthetic oligonucleotide
gattctcaaacaaaccacactccaa

SEQ ID NO: 738458 - DNA, 25 bp, Artificial sequence
  Synthetic oligonucleotide
aaaccctaaattacctcaagactga

SEQ ID NO: 738459 - DNA, 25 bp, Artificial sequence
  Synthetic oligonucleotide
tagtgcattcatggcttagataagt

SEQ ID NO: 738460 - DNA, 25 bp, Artificial sequence
  Synthetic oligonucleotide
taataatggaaatcagaaagaaaaa

SEQ ID NO: 738461 - DNA, 25 bp, Artificial sequence
  Synthetic oligonucleotide
gaatcacaactctgtgtaagtcgca

SEQ ID NO: 738462 - DNA, 25 bp, Artificial sequence
  Synthetic oligonucleotide
tctcctgaacaacacaagcccaagg

SEQ ID NO: 738463 - DNA, 25 bp, Artificial sequence
  Synthetic oligonucleotide
tctcctgaacaagacaagcccaagg

SEQ ID NO: 738464 - DNA, 25 bp, Artificial sequence
  Synthetic oligonucleotide
tctcttgtacttcctcctgatcata

SEQ ID NO: 738465 - DNA, 25 bp, Artificial sequence
  Synthetic oligonucleotide
tctcttgtacttgctcctgatcata

SEQ ID NO: 738466 - DNA, 25 bp, Artificial sequence
  Synthetic oligonucleotide
ctatttggagagtccaatactttcc

SEQ ID NO: 738467 - DNA, 25 bp, Artificial sequence
  Synthetic oligonucleotide
ctatttggagagaccaatactttcc

SEQ ID NO: 738468 - DNA, 25 bp, Artificial sequence
  Synthetic oligonucleotide
gttttgatgaacaaaaacattagta

SEQ ID NO: 738469 - DNA, 25 bp, Artificial sequence
  Synthetic oligonucleotide
gttttgatgaactaaaacattagta

SEQ ID NO: 738470 - DNA, 25 bp, Artificial sequence
  Synthetic oligonucleotide
tctactgctaaaaaagttactgatg

SEQ ID NO: 738471 - DNA, 25 bp, Artificial sequence
  Synthetic oligonucleotide
tctactgctaaataagttactgatg

SEQ ID NO: 738472 - DNA, 25 bp, Artificial sequence
  Synthetic oligonucleotide
cgaaaaacagatctaaaccatttat

SEQ ID NO: 738473 - DNA, 25 bp, Artificial sequence
  Synthetic oligonucleotide
cgaaaaacagatgtaaaccatttat

SEQ ID NO: 738474 - DNA, 25 bp, Artificial sequence
  Synthetic oligonucleotide
tagtgcattcatcgcttagataagt

SEQ ID NO: 738475 - DNA, 25 bp, Artificial sequence
  Synthetic oligonucleotide
actacagcgcgtcgcaacgagacgt

SEQ ID NO: 738476 - DNA, 25 bp, Artificial sequence
  Synthetic oligonucleotide
tgcccctccttctttctccggtctc

SEQ ID NO: 738477 - DNA, 25 bp, Artificial sequence
  Synthetic oligonucleotide
caggctgaacaggtggatacttagt

SEQ ID NO: 738478 - DNA, 25 bp, Artificial sequence
  Synthetic oligonucleotide
gccttctccggcaagtatagtgact

SEQ ID NO: 738479 - DNA, 25 bp, Artificial sequence
  Synthetic oligonucleotide
gccttctccggctagtatagtgact

SEQ ID NO: 738480 - DNA, 25 bp, Artificial sequence
  Synthetic oligonucleotide
tgaccacagaaaaatttatacctac

SEQ ID NO: 738481 - DNA, 25 bp, Artificial sequence
  Synthetic oligonucleotide
tgaccacagaaatatttatacctac

SEQ ID NO: 738482 - DNA, 25 bp, Artificial sequence
  Synthetic oligonucleotide
taggaatactttaaccaaattatta

SEQ ID NO: 738483 - DNA, 25 bp, Artificial sequence
  Synthetic oligonucleotide
taggaatacttttaccaaattatta

SEQ ID NO: 738484 - DNA, 25 bp, Artificial sequence
  Synthetic oligonucleotide
caatcttagaaaatagtagtactaa

SEQ ID NO: 738485 - DNA, 25 bp, Artificial sequence
  Synthetic oligonucleotide
caatcttagaaattagtagtactaa

SEQ ID NO: 738486 - DNA, 25 bp, Artificial sequence
  Synthetic oligonucleotide
cgtctcgacggaaacagtgttaatg

SEQ ID NO: 738487 - DNA, 25 bp, Artificial sequence
  Synthetic oligonucleotide
cgtctcgacggatacagtgttaatg

SEQ ID NO: 738488 - DNA, 25 bp, Artificial sequence
  Synthetic oligonucleotide
gcttgggttaataagagacacatgc

SEQ ID NO: 738489 - DNA, 25 bp, Artificial sequence
  Synthetic oligonucleotide
catcgaccatttagggcacctgatc

SEQ ID NO: 738490 - DNA, 25 bp, Artificial sequence
  Synthetic oligonucleotide
gcttgggttaattagagacacatgc

SEQ ID NO: 738491 - DNA, 25 bp, Artificial sequence
  Synthetic oligonucleotide
actacagcgcgtggcaacgagacgt

SEQ ID NO: 738492 - DNA, 25 bp, Artificial sequence
  Synthetic oligonucleotide
gagaacgaggcttgatgataccatc

SEQ ID NO: 738493 - DNA, 25 bp, Artificial sequence
  Synthetic oligonucleotide
gagaacgaggctagatgataccatc

SEQ ID NO: 738494 - DNA, 25 bp, Artificial sequence
  Synthetic oligonucleotide
gaaagacaaaattaccctcgagagt

SEQ ID NO: 738495 - DNA, 25 bp, Artificial sequence
  Synthetic oligonucleotide
gaaagacaaaataaccctcgagagt

SEQ ID NO: 738496 - DNA, 25 bp, Artificial sequence
  Synthetic oligonucleotide
agagcacaaccaccaaccctctcat

SEQ ID NO: 738497 - DNA, 25 bp, Artificial sequence
  Synthetic oligonucleotide
agagcacaaccagcaaccctctcat

SEQ ID NO: 738498 - DNA, 25 bp, Artificial sequence
  Synthetic oligonucleotide
tctgctaccttatgctgagagagtc

SEQ ID NO: 738499 - DNA, 25 bp, Artificial sequence
  Synthetic oligonucleotide
tctgctaccttaagctgagagagtc

SEQ ID NO: 738500 - DNA, 25 bp, Artificial sequence
  Synthetic oligonucleotide
gtctctatctctcctctttgccttt

SEQ ID NO: 738501 - DNA, 25 bp, Artificial sequence
  Synthetic oligonucleotide
gtctctatctctgctctttgccttt

SEQ ID NO: 738502 - DNA, 25 bp, Artificial sequence
  Synthetic oligonucleotide
gccaaacccgacgacatggcagcta

SEQ ID NO: 738503 - DNA, 25 bp, Artificial sequence
  Synthetic oligonucleotide
gccaaacccgaccacatggcagcta

SEQ ID NO: 738504 - DNA, 25 bp, Artificial sequence
  Synthetic oligonucleotide
catcgaccattttgggcacctgatc

SEQ ID NO: 738505 - DNA, 25 bp, Artificial sequence
  Synthetic oligonucleotide
gagtagtattactattaaccattag

SEQ ID NO: 738506 - DNA, 25 bp, Artificial sequence
  Synthetic oligonucleotide
tttatttgattgaaattttttgacg

SEQ ID NO: 738507 - DNA, 25 bp, Artificial sequence
  Synthetic oligonucleotide
gattggtagcttgttatcaaaacag

SEQ ID NO: 738508 - DNA, 25 bp, Artificial sequence
  Synthetic oligonucleotide
gattggtagcttcttatcaaaacag

SEQ ID NO: 738509 - DNA, 25 bp, Artificial sequence
  Synthetic oligonucleotide
taccgtttaaaagatccaatgaaac

SEQ ID NO: 738510 - DNA, 25 bp, Artificial sequence
  Synthetic oligonucleotide
taccgtttaaaacatccaatgaaac

SEQ ID NO: 738511 - DNA, 25 bp, Artificial sequence
  Synthetic oligonucleotide
tgaaatcaatgtttggacaaaaagg

SEQ ID NO: 738512 - DNA, 25 bp, Artificial sequence
  Synthetic oligonucleotide
tgaaatcaatgtatggacaaaaagg

SEQ ID NO: 738513 - DNA, 25 bp, Artificial sequence
  Synthetic oligonucleotide
tggatcattctctcccaaactatgg

SEQ ID NO: 738514 - DNA, 25 bp, Artificial sequence
  Synthetic oligonucleotide
tggatcattctcacccaaactatgg

SEQ ID NO: 738515 - DNA, 25 bp, Artificial sequence
  Synthetic oligonucleotide
gagccactttgcgtgagctttcaaa

SEQ ID NO: 738516 - DNA, 25 bp, Artificial sequence
  Synthetic oligonucleotide
gagccactttgcctgagctttcaaa

SEQ ID NO: 738517 - DNA, 25 bp, Artificial sequence
  Synthetic oligonucleotide
taataaatgaataacaaagatctct

SEQ ID NO: 738518 - DNA, 25 bp, Artificial sequence
  Synthetic oligonucleotide
caggctgaacagctggatacttagt

SEQ ID NO: 738519 - DNA, 25 bp, Artificial sequence
  Synthetic oligonucleotide
gagtagtattacaattaaccattag

SEQ ID NO: 738520 - DNA, 25 bp, Artificial sequence
  Synthetic oligonucleotide
tggtttaaaggaaggattctcaagc

SEQ ID NO: 738521 - DNA, 25 bp, Artificial sequence
  Synthetic oligonucleotide
tcttgttgcttgtcaattggaatga

SEQ ID NO: 738522 - DNA, 25 bp, Artificial sequence
  Synthetic oligonucleotide
tcttgttgcttgacaattggaatga

SEQ ID NO: 738523 - DNA, 25 bp, Artificial sequence
  Synthetic oligonucleotide
gaaccaaactgtaagataaaatgtc

SEQ ID NO: 738524 - DNA, 25 bp, Artificial sequence
  Synthetic oligonucleotide
gaaccaaactgttagataaaatgtc

SEQ ID NO: 738525 - DNA, 25 bp, Artificial sequence
  Synthetic oligonucleotide
agttcacagaaaagtggccatacgg

SEQ ID NO: 738526 - DNA, 25 bp, Artificial sequence
  Synthetic oligonucleotide
agttcacagaaatgtggccatacgg

SEQ ID NO: 738527 - DNA, 25 bp, Artificial sequence
  Synthetic oligonucleotide
gaaagctgaccggaaagtgatcact

SEQ ID NO: 738528 - DNA, 25 bp, Artificial sequence
  Synthetic oligonucleotide
gaaagctgaccgcaaagtgatcact

SEQ ID NO: 738529 - DNA, 25 bp, Artificial sequence
  Synthetic oligonucleotide
aagttggaggaactgggctgcgacg

SEQ ID NO: 738530 - DNA, 25 bp, Artificial sequence
  Synthetic oligonucleotide
aagttggaggaagtgggctgcgacg

SEQ ID NO: 738531 - DNA, 25 bp, Artificial sequence
  Synthetic oligonucleotide
ccaatggtttaccttggtgagacgc

SEQ ID NO: 738532 - DNA, 25 bp, Artificial sequence
  Synthetic oligonucleotide
accctataggggtaagagtggactg

SEQ ID NO: 738533 - DNA, 25 bp, Artificial sequence
  Synthetic oligonucleotide
tggtttaaaggatggattctcaagc

SEQ ID NO: 738534 - DNA, 25 bp, Artificial sequence
  Synthetic oligonucleotide
taataaatgaattacaaagatctct

SEQ ID NO: 738535 - DNA, 25 bp, Artificial sequence
  Synthetic oligonucleotide
tgagtcaagctcactatatttggag

SEQ ID NO: 738536 - DNA, 25 bp, Artificial sequence
  Synthetic oligonucleotide
accctataggggaaagagtggactg

SEQ ID NO: 738537 - DNA, 25 bp, Artificial sequence
  Synthetic oligonucleotide
gctgcagtttttcgttggaggaaac

SEQ ID NO: 738538 - DNA, 25 bp, Artificial sequence
  Synthetic oligonucleotide
gctgcagtttttggttggaggaaac

SEQ ID NO: 738539 - DNA, 25 bp, Artificial sequence
  Synthetic oligonucleotide
gtaagtacatataatgctcattgtc

SEQ ID NO: 738540 - DNA, 25 bp, Artificial sequence
  Synthetic oligonucleotide
gtaagtacatattatgctcattgtc

SEQ ID NO: 738541 - DNA, 25 bp, Artificial sequence
  Synthetic oligonucleotide
tctgtatgttgtctctcggccctga

SEQ ID NO: 738542 - DNA, 25 bp, Artificial sequence
  Synthetic oligonucleotide
tctgtatgttgtgtctcggccctga

SEQ ID NO: 738543 - DNA, 25 bp, Artificial sequence
  Synthetic oligonucleotide
tatgttggcatgagttttagaacgg

SEQ ID NO: 738544 - DNA, 25 bp, Artificial sequence
  Synthetic oligonucleotide
tatgttggcatgtgttttagaacgg

SEQ ID NO: 738545 - DNA, 25 bp, Artificial sequence
  Synthetic oligonucleotide
gccaagcttatctccgatctcaaca

SEQ ID NO: 738546 - DNA, 25 bp, Artificial sequence
  Synthetic oligonucleotide
gccaagcttatcaccgatctcaaca

SEQ ID NO: 738547 - DNA, 25 bp, Artificial sequence
  Synthetic oligonucleotide
gaagcagatgtacgtgagtttctgc

SEQ ID NO: 738548 - DNA, 25 bp, Artificial sequence
  Synthetic oligonucleotide
gttgtctaaacacttgctatctctg

SEQ ID NO: 738549 - DNA, 25 bp, Artificial sequence
  Synthetic oligonucleotide
tgagtcaagctctctatatttggag

SEQ ID NO: 738550 - DNA, 25 bp, Artificial sequence
  Synthetic oligonucleotide
gttgtctaaacagttgctatctctg

SEQ ID NO: 738551 - DNA, 25 bp, Artificial sequence
  Synthetic oligonucleotide
ttctgatttgaatatggacctcatg

SEQ ID NO: 738552 - DNA, 25 bp, Artificial sequence
  Synthetic oligonucleotide
ttctgatttgaaaatggacctcatg

SEQ ID NO: 738553 - DNA, 25 bp, Artificial sequence
  Synthetic oligonucleotide
ctaaatgatcgtatttgcgtagatg

SEQ ID NO: 738554 - DNA, 25 bp, Artificial sequence
  Synthetic oligonucleotide
ctaaatgatcgtttttgcgtagatg

SEQ ID NO: 738555 - DNA, 25 bp, Artificial sequence
  Synthetic oligonucleotide
catttgtctacaacgaccaggtcaa

SEQ ID NO: 738556 - DNA, 25 bp, Artificial sequence
  Synthetic oligonucleotide
catttgtctacatcgaccaggtcaa

SEQ ID NO: 738557 - DNA, 25 bp, Artificial sequence
  Synthetic oligonucleotide
tgacagaccgtattgacatatcagg

SEQ ID NO: 738558 - DNA, 25 bp, Artificial sequence
  Synthetic oligonucleotide
tgacagaccgtaatgacatatcagg

SEQ ID NO: 738559 - DNA, 25 bp, Artificial sequence
  Synthetic oligonucleotide
tcttgggttgggtaaggtggagcct

SEQ ID NO: 738560 - DNA, 25 bp, Artificial sequence
  Synthetic oligonucleotide
tcttgggttgggaaaggtggagcct

SEQ ID NO: 738561 - DNA, 25 bp, Artificial sequence
  Synthetic oligonucleotide
tcaggttacgacttctctttttcac

SEQ ID NO: 738562 - DNA, 25 bp, Artificial sequence
  Synthetic oligonucleotide
tcaggttacgacatctctttttcac

SEQ ID NO: 738563 - DNA, 25 bp, Artificial sequence
  Synthetic oligonucleotide
tgcccctccttcattctccggtctc

SEQ ID NO: 738564 - DNA, 25 bp, Artificial sequence
  Synthetic oligonucleotide
gaagcagatgtaggtgagtttctgc

SEQ ID NO: 738565 - DNA, 25 bp, Artificial sequence
  Synthetic oligonucleotide
cagattctctaatttgtttttggca

SEQ ID NO: 738566 - DNA, 25 bp, Artificial sequence
  Synthetic oligonucleotide
atttctcccaagctcgacgctgccg

SEQ ID NO: 738567 - DNA, 25 bp, Artificial sequence
  Synthetic oligonucleotide
atttctcccaaggtcgacgctgccg

SEQ ID NO: 738568 - DNA, 25 bp, Artificial sequence
  Synthetic oligonucleotide
caatccttcttccaccgcgtcaatt

SEQ ID NO: 738569 - DNA, 25 bp, Artificial sequence
  Synthetic oligonucleotide
caatccttcttcgaccgcgtcaatt

SEQ ID NO: 738570 - DNA, 25 bp, Artificial sequence
  Synthetic oligonucleotide
tcgtttcttcctgttcttcttctca

SEQ ID NO: 738571 - DNA, 25 bp, Artificial sequence
  Synthetic oligonucleotide
tcgtttcttcctcttcttcttctca

SEQ ID NO: 738572 - DNA, 25 bp, Artificial sequence
  Synthetic oligonucleotide
ccccagaggtgtagttgccatggct

SEQ ID NO: 738573 - DNA, 25 bp, Artificial sequence
  Synthetic oligonucleotide
ccccagaggtgttgttgccatggct

SEQ ID NO: 738574 - DNA, 25 bp, Artificial sequence
  Synthetic oligonucleotide
caactttaaccctcaaactctattg

SEQ ID NO: 738575 - DNA, 25 bp, Artificial sequence
  Synthetic oligonucleotide
caactttaacccacaaactctattg

SEQ ID NO: 738576 - DNA, 25 bp, Artificial sequence
  Synthetic oligonucleotide
cattgtttaggaatgagtgtgtgag

SEQ ID NO: 738577 - DNA, 25 bp, Artificial sequence
  Synthetic oligonucleotide
cattgtttaggattgagtgtgtgag

SEQ ID NO: 738578 - DNA, 25 bp, Artificial sequence
  Synthetic oligonucleotide
ccttttacttgcttgattggtatca

SEQ ID NO: 738579 - DNA, 25 bp, Artificial sequence
  Synthetic oligonucleotide
aatgctagattctggatttcgagtg

SEQ ID NO: 738580 - DNA, 25 bp, Artificial sequence
  Synthetic oligonucleotide
taagaatctcaattctcttcattgc

SEQ ID NO: 738581 - DNA, 25 bp, Artificial sequence
  Synthetic oligonucleotide
aatgctagattcaggatttcgagtg

SEQ ID NO: 738582 - DNA, 25 bp, Artificial sequence
  Synthetic oligonucleotide
agctttggttttctttcctactcca

SEQ ID NO: 738583 - DNA, 25 bp, Artificial sequence
  Synthetic oligonucleotide
ccttttacttgcatgattggtatca

SEQ ID NO: 738584 - DNA, 25 bp, Artificial sequence
  Synthetic oligonucleotide
agctttggttttgtttcctactcca

SEQ ID NO: 738585 - DNA, 25 bp, Artificial sequence
  Synthetic oligonucleotide
cagattctctaaattgtttttggca

SEQ ID NO: 738586 - DNA, 25 bp, Artificial sequence
  Synthetic oligonucleotide
taagaatctcaaatctcttcattgc

SEQ ID NO: 738587 - DNA, 25 bp, Artificial sequence
  Synthetic oligonucleotide
tatgattgaggaagaaagttattcc

SEQ ID NO: 738588 - DNA, 25 bp, Artificial sequence
  Synthetic oligonucleotide
tatgattgaggatgaaagttattcc

SEQ ID NO: 738589 - DNA, 25 bp, Artificial sequence
  Synthetic oligonucleotide
ggtttgctttgctacaccacaaatg

SEQ ID NO: 738590 - DNA, 25 bp, Artificial sequence
  Synthetic oligonucleotide
ggtttgctttgcaacaccacaaatg

SEQ ID NO: 738591 - DNA, 25 bp, Artificial sequence
  Synthetic oligonucleotide
tctcctcagtctacaattgattcaa

SEQ ID NO: 738592 - DNA, 25 bp, Artificial sequence
  Synthetic oligonucleotide
tctcctcagtcttcaattgattcaa

SEQ ID NO: 738593 - DNA, 25 bp, Artificial sequence
  Synthetic oligonucleotide
tttatttgattgtaattttttgacg

SEQ ID NO: 738594 - DNA, 25 bp, Artificial sequence
  Synthetic oligonucleotide
acagtgctgtctggtggcaccacca

SEQ ID NO: 738595 - DNA, 25 bp, Artificial sequence
  Synthetic oligonucleotide
tcctgaccgagcgtggctacagctt

SEQ ID NO: 738596 - DNA, 25 bp, Artificial sequence
  Synthetic oligonucleotide
ctgagagggaaatcgtgcgtgacat

SEQ ID NO: 738597 - DNA, 25 bp, Artificial sequence
  Synthetic oligonucleotide
gaagctgtgctatgttgccctagac

SEQ ID NO: 738598 - DNA, 25 bp, Artificial sequence
  Synthetic oligonucleotide
agagatggccactgccgcatcctct

SEQ ID NO: 738599 - DNA, 25 bp, Artificial sequence
  Synthetic oligonucleotide
gaagagctatgagctgcctgacggt

SEQ ID NO: 738600 - DNA, 25 bp, Artificial sequence
  Synthetic oligonucleotide
tggctggccgggacctgacagacta

SEQ ID NO: 738601 - DNA, 25 bp, Artificial sequence
  Synthetic oligonucleotide
tgtgacgttgacatccgtaaagacc

SEQ ID NO: 738602 - DNA, 25 bp, Artificial sequence
  Synthetic oligonucleotide
cactatcggcaatgagcggttccga

SEQ ID NO: 738603 - DNA, 25 bp, Artificial sequence
  Synthetic oligonucleotide
tcgctgacaggatgcagaaggagat

SEQ ID NO: 738604 - DNA, 25 bp, Artificial sequence
  Synthetic oligonucleotide
ggctcctagcaccatgaagatcaag

SEQ ID NO: 738605 - DNA, 25 bp, Artificial sequence
  Synthetic oligonucleotide
tcctgagcgcaagtactctgtgtgg

SEQ ID NO: 738606 - DNA, 25 bp, Artificial sequence
  Synthetic oligonucleotide
tatcctggcctcactgtccaccttc

SEQ ID NO: 738607 - DNA, 25 bp, Artificial sequence
  Synthetic oligonucleotide
tcagcaagcaggagtacgatgagtc

SEQ ID NO: 738608 - DNA, 25 bp, Artificial sequence
  Synthetic oligonucleotide
catcgtgcaccgcaaatgcttctag

SEQ ID NO: 738609 - DNA, 25 bp, Artificial sequence
  Synthetic oligonucleotide
tccagccttccttcctgggtatgga

SEQ ID NO: 738610 - DNA, 25 bp, Artificial sequence
  Synthetic oligonucleotide
cgacgatgctccccgggccgtcttc

SEQ ID NO: 738611 - DNA, 25 bp, Artificial sequence
  Synthetic oligonucleotide
tggcatccatgaaactacattcaat

SEQ ID NO: 738612 - DNA, 25 bp, Artificial sequence
  Synthetic oligonucleotide
ggtccgccatgtgcaaggccggctt

SEQ ID NO: 738613 - DNA, 25 bp, Artificial sequence
  Synthetic oligonucleotide
gagggttacgcgctccctcatgcca

SEQ ID NO: 738614 - DNA, 25 bp, Artificial sequence
  Synthetic oligonucleotide
gccgccctaggcaccagggtgtgat

SEQ ID NO: 738615 - DNA, 25 bp, Artificial sequence
  Synthetic oligonucleotide
tcagaaggactcctacgtgggcgac

SEQ ID NO: 738616 - DNA, 25 bp, Artificial sequence
  Synthetic oligonucleotide
gcaagagaggcatcctgaccctgaa

SEQ ID NO: 738617 - DNA, 25 bp, Artificial sequence
  Synthetic oligonucleotide
gaacacggcattgtaaccaactggg

SEQ ID NO: 738618 - DNA, 25 bp, Artificial sequence
  Synthetic oligonucleotide
gaagatttggcaccacactttctac

SEQ ID NO: 738619 - DNA, 25 bp, Artificial sequence
  Synthetic oligonucleotide
tgtggcccctgaggagcaccctgtg

SEQ ID NO: 738620 - DNA, 25 bp, Artificial sequence
  Synthetic oligonucleotide
ctctgaaccctaaggccaaccgtga

SEQ ID NO: 738621 - DNA, 25 bp, Artificial sequence
  Synthetic oligonucleotide
cccagatcatgtttgagaccttcaa

SEQ ID NO: 738622 - DNA, 25 bp, Artificial sequence
  Synthetic oligonucleotide
tgtacgtagccatccaggctgtgtt

SEQ ID NO: 738623 - DNA, 25 bp, Artificial sequence
  Synthetic oligonucleotide
tctggtcgtaccactggcattgtga

SEQ ID NO: 738624 - DNA, 25 bp, Artificial sequence
  Synthetic oligonucleotide
ggagacggggtcacccacactgtgc

SEQ ID NO: 738625 - DNA, 25 bp, Artificial sequence
  Synthetic oligonucleotide
tggatgacgatatcgctgcgctcgt

SEQ ID NO: 738626 - DNA, 25 bp, Artificial sequence
  Synthetic oligonucleotide
gaatatggctacagcaacagggtgg

SEQ ID NO: 738627 - DNA, 25 bp, Artificial sequence
  Synthetic oligonucleotide
gggctcatgaccacagtccatgcca

SEQ ID NO: 738628 - DNA, 25 bp, Artificial sequence
  Synthetic oligonucleotide
cgtgatggccgtggggcagcccaga

SEQ ID NO: 738629 - DNA, 25 bp, Artificial sequence
  Synthetic oligonucleotide
tcatcccagagctgaacgggaagct

SEQ ID NO: 738630 - DNA, 25 bp, Artificial sequence
  Synthetic oligonucleotide
tccgtgttcctacccccaatgtatc

SEQ ID NO: 738631 - DNA, 25 bp, Artificial sequence
  Synthetic oligonucleotide
tgacatgccgcctggagaaacctgc

SEQ ID NO: 738632 - DNA, 25 bp, Artificial sequence
  Synthetic oligonucleotide
acatcaagaaggtggtgaagcaggc

SEQ ID NO: 738633 - DNA, 25 bp, Artificial sequence
  Synthetic oligonucleotide
cactaaagggcatcctgggctacac

SEQ ID NO: 738634 - DNA, 25 bp, Artificial sequence
  Synthetic oligonucleotide
ggttgtctcctgtgacttcaacagc

SEQ ID NO: 738635 - DNA, 25 bp, Artificial sequence
  Synthetic oligonucleotide
gacaacattgtgaagctcatttcct

SEQ ID NO: 738636 - DNA, 25 bp, Artificial sequence
  Synthetic oligonucleotide
ggtcatccatgacaactttggcatc

SEQ ID NO: 738637 - DNA, 25 bp, Artificial sequence
  Synthetic oligonucleotide
ggcctacatggcctccaaggagtaa

SEQ ID NO: 738638 - DNA, 25 bp, Artificial sequence
  Synthetic oligonucleotide
tcagaagactgtggatggcccctct

SEQ ID NO: 738639 - DNA, 25 bp, Artificial sequence
  Synthetic oligonucleotide
tccacctttgatgctggggctggca

SEQ ID NO: 738640 - DNA, 25 bp, Artificial sequence
  Synthetic oligonucleotide
cacggcaagttcaacggcacagtca

SEQ ID NO: 738641 - DNA, 25 bp, Artificial sequence
  Synthetic oligonucleotide
gcatcctgcaccaccaactgcttag

SEQ ID NO: 738642 - DNA, 25 bp, Artificial sequence
  Synthetic oligonucleotide
tgcatccactggtgctgccaaggct

SEQ ID NO: 738643 - DNA, 25 bp, Artificial sequence
  Synthetic oligonucleotide
gaaggtcggtgtgaacggatttggc

SEQ ID NO: 738644 - DNA, 25 bp, Artificial sequence
  Synthetic oligonucleotide
ggttaccagggctgccttctcttgt

SEQ ID NO: 738645 - DNA, 25 bp, Artificial sequence
  Synthetic oligonucleotide
caactacatggtctacatgttccag

SEQ ID NO: 738646 - DNA, 25 bp, Artificial sequence
  Synthetic oligonucleotide
gggaagctggtcatcaacgggaaac

SEQ ID NO: 738647 - DNA, 25 bp, Artificial sequence
  Synthetic oligonucleotide
ttccaggagcgagatcccgtcaaga

SEQ ID NO: 738648 - DNA, 25 bp, Artificial sequence
  Synthetic oligonucleotide
gatgctggtgctgagtatgtcgtgg

SEQ ID NO: 738649 - DNA, 25 bp, Artificial sequence
  Synthetic oligonucleotide
tcttcaccaccatggagaaggctgg

SEQ ID NO: 738650 - DNA, 25 bp, Artificial sequence
  Synthetic oligonucleotide
ggtggggccaaaagggtcatcatct

SEQ ID NO: 738651 - DNA, 25 bp, Artificial sequence
  Synthetic oligonucleotide
cgctgatgcccccatgtttgtgatg

SEQ ID NO: 738652 - DNA, 25 bp, Artificial sequence
  Synthetic oligonucleotide
gagaaatatgacaactccctcaaga

SEQ ID NO: 738653 - DNA, 25 bp, Artificial sequence
  Synthetic oligonucleotide
gacattgttgccatcaacgacccct

SEQ ID NO: 738654 - DNA, 25 bp, Artificial sequence
  Synthetic oligonucleotide
gcctcagcaagcagacgctgatgga

SEQ ID NO: 738655 - DNA, 25 bp, Artificial sequence
  Synthetic oligonucleotide
tgggcttcaccttctcatttccctg

SEQ ID NO: 738656 - DNA, 25 bp, Artificial sequence
  Synthetic oligonucleotide
caccgtgggcaccatgatgacctgt

SEQ ID NO: 738657 - DNA, 25 bp, Artificial sequence
  Synthetic oligonucleotide
aatttgacttggatgtggtggctgt

SEQ ID NO: 738658 - DNA, 25 bp, Artificial sequence
  Synthetic oligonucleotide
cctccttactgagggatgcggtgaa

SEQ ID NO: 738659 - DNA, 25 bp, Artificial sequence
  Synthetic oligonucleotide
gaacccacttgcgaaattggactca

SEQ ID NO: 738660 - DNA, 25 bp, Artificial sequence
  Synthetic oligonucleotide
gtttcaaagccactgactgtgaggg

SEQ ID NO: 738661 - DNA, 25 bp, Artificial sequence
  Synthetic oligonucleotide
acctggactgtggaatcttgatctc

SEQ ID NO: 738662 - DNA, 25 bp, Artificial sequence
  Synthetic oligonucleotide
cctggactacatggggatcaaaggc

SEQ ID NO: 738663 - DNA, 25 bp, Artificial sequence
  Synthetic oligonucleotide
gctgtttgaccacatcgtctcctgc

SEQ ID NO: 738664 - DNA, 25 bp, Artificial sequence
  Synthetic oligonucleotide
cattcccctggaaatcatgcagggc

SEQ ID NO: 738665 - DNA, 25 bp, Artificial sequence
  Synthetic oligonucleotide
aaagagaacagtggaaatgcacaac

SEQ ID NO: 738666 - DNA, 25 bp, Artificial sequence
  Synthetic oligonucleotide
gaacacggtgacttcctggccttgg

SEQ ID NO: 738667 - DNA, 25 bp, Artificial sequence
  Synthetic oligonucleotide
ggcaccaatgcctgctacatggagg

SEQ ID NO: 738668 - DNA, 25 bp, Artificial sequence
  Synthetic oligonucleotide
aagaggctacggacagagatggaaa

SEQ ID NO: 738669 - DNA, 25 bp, Artificial sequence
  Synthetic oligonucleotide
gacccgaggcatctttgagaccaag

SEQ ID NO: 738670 - DNA, 25 bp, Artificial sequence
  Synthetic oligonucleotide
cacattcggcagattgaggaaaccc

SEQ ID NO: 738671 - DNA, 25 bp, Artificial sequence
  Synthetic oligonucleotide
atggtgacggcagtagcctaccgcc

SEQ ID NO: 738672 - DNA, 25 bp, Artificial sequence
  Synthetic oligonucleotide
gaaggagaccaacagcaaagctact

SEQ ID NO: 738673 - DNA, 25 bp, Artificial sequence
  Synthetic oligonucleotide
gacgacagtatcctggtcaagaccg

SEQ ID NO: 738674 - DNA, 25 bp, Artificial sequence
  Synthetic oligonucleotide
ccattccggacggctcagaaaaggg

SEQ ID NO: 738675 - DNA, 25 bp, Artificial sequence
  Synthetic oligonucleotide
tcctctcagagagtggcacgggcaa

SEQ ID NO: 738676 - DNA, 25 bp, Artificial sequence
  Synthetic oligonucleotide
gcaagggggccgcccttatcacagc

SEQ ID NO: 738677 - DNA, 25 bp, Artificial sequence
  Synthetic oligonucleotide
aaagtgtaccgtgtccttcctcctg

SEQ ID NO: 738678 - DNA, 25 bp, Artificial sequence
  Synthetic oligonucleotide
cagaatcatgcaccaaactgtgaag

SEQ ID NO: 738679 - DNA, 25 bp, Artificial sequence
  Synthetic oligonucleotide
tggatgggacgctctacaaacttca

SEQ ID NO: 738680 - DNA, 25 bp, Artificial sequence
  Synthetic oligonucleotide
gaggcctagaccatctgaatgtaac

SEQ ID NO: 738681 - DNA, 25 bp, Artificial sequence
  Synthetic oligonucleotide
gatcgtccgtaacatcctgattgac

SEQ ID NO: 738682 - DNA, 25 bp, Artificial sequence
  Synthetic oligonucleotide
tggtgtccaagagggcggctcagct

SEQ ID NO: 738683 - DNA, 25 bp, Artificial sequence
  Synthetic oligonucleotide
gatggtggaggggaaccagggccag

SEQ ID NO: 738684 - DNA, 25 bp, Artificial sequence
  Synthetic oligonucleotide
cgggccatccttcagcagctgggtt

SEQ ID NO: 738685 - DNA, 25 bp, Artificial sequence
  Synthetic oligonucleotide
cagattgagagtgaccggttagcgc

SEQ ID NO: 738686 - DNA, 25 bp, Artificial sequence
  Synthetic oligonucleotide
aaggcttcctcttccggggacagat

SEQ ID NO: 738687 - DNA, 25 bp, Artificial sequence
  Synthetic oligonucleotide
gagaaaatgatcagtgggatgtacc

SEQ ID NO: 738688 - DNA, 25 bp, Artificial sequence
  Synthetic oligonucleotide
ggacgaatattctctaaactctggg

SEQ ID NO: 738689 - DNA, 25 bp, Artificial sequence
  Synthetic oligonucleotide
tctggatgacatcagaacagacttt

SEQ ID NO: 738690 - DNA, 25 bp, Artificial sequence
  Synthetic oligonucleotide
atcaacatggagtggggcgccttcg

SEQ ID NO: 738691 - DNA, 25 bp, Artificial sequence
  Synthetic oligonucleotide
catggccgccgtggtggaaaagatc

SEQ ID NO: 738692 - DNA, 25 bp, Artificial sequence
  Synthetic oligonucleotide
ggatctcggcgggtcttcctttcga

SEQ ID NO: 738693 - DNA, 25 bp, Artificial sequence
  Synthetic oligonucleotide
tgcaggtgaaccacgagaagaacca

SEQ ID NO: 738694 - DNA, 25 bp, Artificial sequence
  Synthetic oligonucleotide
tggcgtggaaggagcggatgtggtc

SEQ ID NO: 738695 - DNA, 25 bp, Artificial sequence
  Synthetic oligonucleotide
tactgatcacgtggacaaagcggtt

SEQ ID NO: 738696 - DNA, 25 bp, Artificial sequence
  Synthetic oligonucleotide
ttcccctgccgacaatccaagatag

SEQ ID NO: 738697 - DNA, 25 bp, Artificial sequence
  Synthetic oligonucleotide
gatcaaggacaagaagttacccgtg

SEQ ID NO: 738698 - DNA, 25 bp, Artificial sequence
  Synthetic oligonucleotide
gactgcctgggagacttcatggaga

SEQ ID NO: 738699 - DNA, 25 bp, Artificial sequence
  Synthetic oligonucleotide
tgcatggcagtggaacccagctttt

SEQ ID NO: 738700 - DNA, 25 bp, Artificial sequence
  Synthetic oligonucleotide
cattgtcgccgtggtgaatgacaca

SEQ ID NO: 738701 - DNA, 25 bp, Artificial sequence
  Synthetic oligonucleotide
ggctcagaggagacccttcgatcgc

SEQ ID NO: 738702 - DNA, 25 bp, Artificial sequence
  Synthetic oligonucleotide
gatgacctgcggttatgatgaccaa

SEQ ID NO: 738703 - DNA, 25 bp, Artificial sequence
  Synthetic oligonucleotide
tttccgggttctgctggtaaagatc

SEQ ID NO: 738704 - DNA, 25 bp, Artificial sequence
  Synthetic oligonucleotide
tccgtcaagatgctgcccaccttcg

SEQ ID NO: 738705 - DNA, 25 bp, Artificial sequence
  Synthetic oligonucleotide
gaagaatggcctctcccgggattat

SEQ ID NO: 738706 - DNA, 25 bp, Artificial sequence
  Synthetic oligonucleotide
tctgatagatatcctgacacgattc

SEQ ID NO: 738707 - DNA, 25 bp, Artificial sequence
  Synthetic oligonucleotide
caagtatctgtacgccatgcggctc

SEQ ID NO: 738708 - DNA, 25 bp, Artificial sequence
  Synthetic oligonucleotide
caccgagctgaaggatgaccaagtc

SEQ ID NO: 738709 - DNA, 25 bp, Artificial sequence
  Synthetic oligonucleotide
atgatcgccgcgcaactactggcct

SEQ ID NO: 738710 - DNA, 25 bp, Artificial sequence
  Synthetic oligonucleotide
tggagtctgagatctacgacacccc

SEQ ID NO: 738711 - DNA, 25 bp, Artificial sequence
  Synthetic oligonucleotide
gtgaagatggccaaggaaggcctct

SEQ ID NO: 738712 - DNA, 25 bp, Artificial sequence
  Synthetic oligonucleotide
tgcacccacagtactcccggcggtt

SEQ ID NO: 738713 - DNA, 25 bp, Artificial sequence
  Synthetic oligonucleotide
cacggttggcgtggacggttctctc

SEQ ID NO: 738714 - DNA, 25 bp, Artificial sequence
  Synthetic oligonucleotide
tgcgggacaacaagggcacaccacg

SEQ ID NO: 738715 - DNA, 25 bp, Artificial sequence
  Synthetic oligonucleotide
tggtggccgccacgctcggtgccat

SEQ ID NO: 738716 - DNA, 25 bp, Artificial sequence
  Synthetic oligonucleotide
agcacatctgcacgatcgtctcctt

SEQ ID NO: 738717 - DNA, 25 bp, Artificial sequence
  Synthetic oligonucleotide
agtggagccgtctgatgttgactgt

SEQ ID NO: 738718 - DNA, 25 bp, Artificial sequence
  Synthetic oligonucleotide
ggcattcaaaatgccaaggaaatct

SEQ ID NO: 738719 - DNA, 25 bp, Artificial sequence
  Synthetic oligonucleotide
gaataaagccattaagaagcgaggg

SEQ ID NO: 738720 - DNA, 25 bp, Artificial sequence
  Synthetic oligonucleotide
gcatcactccagagctgctcacgag

SEQ ID NO: 738721 - DNA, 25 bp, Artificial sequence
  Synthetic oligonucleotide
tgaggcgcctggtgcctgactccga

SEQ ID NO: 738722 - DNA, 25 bp, Artificial sequence
  Synthetic oligonucleotide
cggcatgtacatgggggagctggtc

SEQ ID NO: 738723 - DNA, 25 bp, Artificial sequence
  Synthetic oligonucleotide
caaccctgggaagcagctgttcgag

SEQ ID NO: 738724 - DNA, 25 bp, Artificial sequence
  Synthetic oligonucleotide
ccgagtttgacagagagttagaccg

SEQ ID NO: 738725 - DNA, 25 bp, Artificial sequence
  Synthetic oligonucleotide
cctttggggatgatgggtccctgga

SEQ ID NO: 738726 - DNA, 25 bp, Artificial sequence
  Synthetic oligonucleotide
cgacgaggggaggatgtgtattaac

SEQ ID NO: 738727 - DNA, 25 bp, Artificial sequence
  Synthetic oligonucleotide
tgctacatggaggaactgcgacaca

SEQ ID NO: 738728 - DNA, 25 bp, Artificial sequence
  Synthetic oligonucleotide
gaagtcggcctgatcattggcacag

SEQ ID NO: 738729 - DNA, 25 bp, Artificial sequence
  Synthetic oligonucleotide
cactagtgacgtgtccgccattgaa

SEQ ID NO: 738730 - DNA, 25 bp, Artificial sequence
  Synthetic oligonucleotide
gccttcttttgtccggagcatcccg

SEQ ID NO: 738731 - DNA, 25 bp, Artificial sequence
  Synthetic oligonucleotide
ggcaacagttatgcagaagaccaga

SEQ ID NO: 738732 - DNA, 25 bp, Artificial sequence
  Synthetic oligonucleotide
aatgtaggcaggcaacagttatcca

SEQ ID NO: 738733 - DNA, 25 bp, Artificial sequence
  Synthetic oligonucleotide
aatgtaggcagggaacagttatcca

SEQ ID NO: 738734 - DNA, 25 bp, Artificial sequence
  Synthetic oligonucleotide
gtaggcaggcaacagttatccagaa

SEQ ID NO: 738735 - DNA, 25 bp, Artificial sequence
  Synthetic oligonucleotide
gtaggcaggcaagagttatccagaa

SEQ ID NO: 738736 - DNA, 25 bp, Artificial sequence
  Synthetic oligonucleotide
taggcaggcaacagttatccagaag

SEQ ID NO: 738737 - DNA, 25 bp, Artificial sequence
  Synthetic oligonucleotide
taggcaggcaactgttatccagaag

SEQ ID NO: 738738 - DNA, 25 bp, Artificial sequence
  Synthetic oligonucleotide
aggcaggcaacagttatccagaaga

SEQ ID NO: 738739 - DNA, 25 bp, Artificial sequence
  Synthetic oligonucleotide
aggcaggcaacacttatccagaaga

SEQ ID NO: 738740 - DNA, 25 bp, Artificial sequence
  Synthetic oligonucleotide
ggcaggcaacagatatccagaagac

SEQ ID NO: 738741 - DNA, 25 bp, Artificial sequence
  Synthetic oligonucleotide
ggcaggcaacagttatccagaagac

SEQ ID NO: 738742 - DNA, 25 bp, Artificial sequence
  Synthetic oligonucleotide
gcaggcaacagtaatccagaagacc

SEQ ID NO: 738743 - DNA, 25 bp, Artificial sequence
  Synthetic oligonucleotide
gcaggcaacagttatccagaagacc

SEQ ID NO: 738744 - DNA, 25 bp, Artificial sequence
  Synthetic oligonucleotide
ttaatgtaggcacgcaacagttatc

SEQ ID NO: 738745 - DNA, 25 bp, Artificial sequence
  Synthetic oligonucleotide
aggcaacagttaaccagaagaccag

SEQ ID NO: 738746 - DNA, 25 bp, Artificial sequence
  Synthetic oligonucleotide
caggcaacagttatccagaagacca

SEQ ID NO: 738747 - DNA, 25 bp, Artificial sequence
  Synthetic oligonucleotide
ggcaacagttatccagaagaccaga

SEQ ID NO: 738748 - DNA, 25 bp, Artificial sequence
  Synthetic oligonucleotide
gcaacagttatcgagaagaccagag

SEQ ID NO: 738749 - DNA, 25 bp, Artificial sequence
  Synthetic oligonucleotide
gcaacagttatccagaagaccagag

SEQ ID NO: 738750 - DNA, 25 bp, Artificial sequence
  Synthetic oligonucleotide
caacagttatcctgaagaccagagg

SEQ ID NO: 738751 - DNA, 25 bp, Artificial sequence
  Synthetic oligonucleotide
caacagttatccagaagaccagagg

SEQ ID NO: 738752 - DNA, 25 bp, Artificial sequence
  Synthetic oligonucleotide
aacagttatccagaagaccagagga

SEQ ID NO: 738753 - DNA, 25 bp, Artificial sequence
  Synthetic oligonucleotide
aacagttatccacaagaccagagga

SEQ ID NO: 738754 - DNA, 25 bp, Artificial sequence
  Synthetic oligonucleotide
acagttatccagtagaccagaggaa

SEQ ID NO: 738755 - DNA, 25 bp, Artificial sequence
  Synthetic oligonucleotide
acagttatccagaagaccagaggaa

SEQ ID NO: 738756 - DNA, 25 bp, Artificial sequence
  Synthetic oligonucleotide
cagttatccagaagaccagaggaaa

SEQ ID NO: 738757 - DNA, 25 bp, Artificial sequence
  Synthetic oligonucleotide
cagttatccagatgaccagaggaaa

SEQ ID NO: 738758 - DNA, 25 bp, Artificial sequence
  Synthetic oligonucleotide
gacagaaattaaagtaggcaggcaa

SEQ ID NO: 738759 - DNA, 25 bp, Artificial sequence
  Synthetic oligonucleotide
caggcaacagttttccagaagacca

SEQ ID NO: 738760 - DNA, 25 bp, Artificial sequence
  Synthetic oligonucleotide
gaggagacagaatttaatgtaggca

SEQ ID NO: 738761 - DNA, 25 bp, Artificial sequence
  Synthetic oligonucleotide
gttgaggagacagaaattaatgtag

SEQ ID NO: 738762 - DNA, 25 bp, Artificial sequence
  Synthetic oligonucleotide
gttgaggagacacaaattaatgtag

SEQ ID NO: 738763 - DNA, 25 bp, Artificial sequence
  Synthetic oligonucleotide
ttgaggagacagaaattaatgtagg

SEQ ID NO: 738764 - DNA, 25 bp, Artificial sequence
  Synthetic oligonucleotide
ttgaggagacagtaattaatgtagg

SEQ ID NO: 738765 - DNA, 25 bp, Artificial sequence
  Synthetic oligonucleotide
tgaggagacagaaattaatgtaggc

SEQ ID NO: 738766 - DNA, 25 bp, Artificial sequence
  Synthetic oligonucleotide
agttgaggagactgaaattaatgta

SEQ ID NO: 738767 - DNA, 25 bp, Artificial sequence
  Synthetic oligonucleotide
gaggagacagaaattaatgtaggca

SEQ ID NO: 738768 - DNA, 25 bp, Artificial sequence
  Synthetic oligonucleotide
ggagacagaaataaatgtaggcagg

SEQ ID NO: 738769 - DNA, 25 bp, Artificial sequence
  Synthetic oligonucleotide
aggagacagaaaataatgtaggcag

SEQ ID NO: 738770 - DNA, 25 bp, Artificial sequence
  Synthetic oligonucleotide
aggagacagaaattaatgtaggcag

SEQ ID NO: 738771 - DNA, 25 bp, Artificial sequence
  Synthetic oligonucleotide
ggagacagaaattaatgtaggcagg

SEQ ID NO: 738772 - DNA, 25 bp, Artificial sequence
  Synthetic oligonucleotide
ttaatgtaggcaggcaacagttatc

SEQ ID NO: 738773 - DNA, 25 bp, Artificial sequence
  Synthetic oligonucleotide
gacagaaattaatgtaggcaggcaa

SEQ ID NO: 738774 - DNA, 25 bp, Artificial sequence
  Synthetic oligonucleotide
aggcaacagttatccagaagaccag

SEQ ID NO: 738775 - DNA, 25 bp, Artificial sequence
  Synthetic oligonucleotide
tgaggagacagatattaatgtaggc

SEQ ID NO: 738776 - DNA, 25 bp, Artificial sequence
  Synthetic oligonucleotide
aattaatgtaggcaggcaacagtta

SEQ ID NO: 738777 - DNA, 25 bp, Artificial sequence
  Synthetic oligonucleotide
agttgaggagacagaaattaatgta

SEQ ID NO: 738778 - DNA, 25 bp, Artificial sequence
  Synthetic oligonucleotide
attaatgtaggctggcaacagttat

SEQ ID NO: 738779 - DNA, 25 bp, Artificial sequence
  Synthetic oligonucleotide
aattaatgtagggaggcaacagtta

SEQ ID NO: 738780 - DNA, 25 bp, Artificial sequence
  Synthetic oligonucleotide
aaattaatgtagccaggcaacagtt

SEQ ID NO: 738781 - DNA, 25 bp, Artificial sequence
  Synthetic oligonucleotide
aaattaatgtaggcaggcaacagtt

SEQ ID NO: 738782 - DNA, 25 bp, Artificial sequence
  Synthetic oligonucleotide
gaaattaatgtaggcaggcaacagt

SEQ ID NO: 738783 - DNA, 25 bp, Artificial sequence
  Synthetic oligonucleotide
gaaattaatgtacgcaggcaacagt

SEQ ID NO: 738784 - DNA, 25 bp, Artificial sequence
  Synthetic oligonucleotide
agaaattaatgttggcaggcaacag

SEQ ID NO: 738785 - DNA, 25 bp, Artificial sequence
  Synthetic oligonucleotide
cagaaattaatgaaggcaggcaaca

SEQ ID NO: 738786 - DNA, 25 bp, Artificial sequence
  Synthetic oligonucleotide
cagaaattaatgtaggcaggcaaca

SEQ ID NO: 738787 - DNA, 25 bp, Artificial sequence
  Synthetic oligonucleotide
acagaaattaatgtaggcaggcaac

SEQ ID NO: 738788 - DNA, 25 bp, Artificial sequence
  Synthetic oligonucleotide
acagaaattaatctaggcaggcaac

SEQ ID NO: 738789 - DNA, 25 bp, Artificial sequence
  Synthetic oligonucleotide
agaaattaatgtaggcaggcaacag

SEQ ID NO: 738790 - DNA, 25 bp, Artificial sequence
  Synthetic oligonucleotide
attaatgtaggcaggcaacagttat

SEQ ID NO: 738791 - DNA, 25 bp, Artificial sequence
  Synthetic oligonucleotide
aatgtaggcaggcaacagttatcca

SEQ ID NO: 738792 - DNA, 25 bp, Artificial sequence
  Synthetic oligonucleotide
gcaggcaacagtaatccagaagacc

SEQ ID NO: 738793 - DNA, 25 bp, Artificial sequence
  Synthetic oligonucleotide
gcaggcaacagttatccagaagacc

SEQ ID NO: 738794 - DNA, 25 bp, Artificial sequence
  Synthetic oligonucleotide
ggcaggcaacagttatccagaagac

SEQ ID NO: 738795 - DNA, 25 bp, Artificial sequence
  Synthetic oligonucleotide
ggcaggcaacagatatccagaagac

SEQ ID NO: 738796 - DNA, 25 bp, Artificial sequence
  Synthetic oligonucleotide
aggcaggcaacagttatccagaaga

SEQ ID NO: 738797 - DNA, 25 bp, Artificial sequence
  Synthetic oligonucleotide
aggcaggcaacacttatccagaaga

SEQ ID NO: 738798 - DNA, 25 bp, Artificial sequence
  Synthetic oligonucleotide
taggcaggcaactgttatccagaag

SEQ ID NO: 738799 - DNA, 25 bp, Artificial sequence
  Synthetic oligonucleotide
ttaatgtaggcacgcaacagttatc

SEQ ID NO: 738800 - DNA, 25 bp, Artificial sequence
  Synthetic oligonucleotide
taggcaggcaacagttatccagaag

SEQ ID NO: 738801 - DNA, 25 bp, Artificial sequence
  Synthetic oligonucleotide
gtaggcaggcaacagttatccagaa

SEQ ID NO: 738802 - DNA, 25 bp, Artificial sequence
  Synthetic oligonucleotide
aatgtaggcagggaacagttatcca

SEQ ID NO: 738803 - DNA, 25 bp, Artificial sequence
  Synthetic oligonucleotide
caggcaacagttatccagaagacca

SEQ ID NO: 738804 - DNA, 25 bp, Artificial sequence
  Synthetic oligonucleotide
ttaatgtaggcaggcaacagttatc

SEQ ID NO: 738805 - DNA, 25 bp, Artificial sequence
  Synthetic oligonucleotide
caacagttatccagaagaccagagg

SEQ ID NO: 738806 - DNA, 25 bp, Artificial sequence
  Synthetic oligonucleotide
gtaggcaggcaagagttatccagaa

SEQ ID NO: 738807 - DNA, 25 bp, Artificial sequence
  Synthetic oligonucleotide
caacagttatcctgaagaccagagg

SEQ ID NO: 738808 - DNA, 25 bp, Artificial sequence
  Synthetic oligonucleotide
attaatgtaggcaggcaacagttat

SEQ ID NO: 738809 - DNA, 25 bp, Artificial sequence
  Synthetic oligonucleotide
aaattaatgtaggcaggcaacagtt

SEQ ID NO: 738810 - DNA, 25 bp, Artificial sequence
  Synthetic oligonucleotide
cagttatccagaagaccagaggaaa

SEQ ID NO: 738811 - DNA, 25 bp, Artificial sequence
  Synthetic oligonucleotide
acagttatccagtagaccagaggaa

SEQ ID NO: 738812 - DNA, 25 bp, Artificial sequence
  Synthetic oligonucleotide
acagttatccagaagaccagaggaa

SEQ ID NO: 738813 - DNA, 25 bp, Artificial sequence
  Synthetic oligonucleotide
gcaacagttatcgagaagaccagag

SEQ ID NO: 738814 - DNA, 25 bp, Artificial sequence
  Synthetic oligonucleotide
aacagttatccagaagaccagagga

SEQ ID NO: 738815 - DNA, 25 bp, Artificial sequence
  Synthetic oligonucleotide
caggcaacagttttccagaagacca

SEQ ID NO: 738816 - DNA, 25 bp, Artificial sequence
  Synthetic oligonucleotide
cagttatccagatgaccagaggaaa

SEQ ID NO: 738817 - DNA, 25 bp, Artificial sequence
  Synthetic oligonucleotide
gcaacagttatccagaagaccagag

SEQ ID NO: 738818 - DNA, 25 bp, Artificial sequence
  Synthetic oligonucleotide
ggcaacagttatgcagaagaccaga

SEQ ID NO: 738819 - DNA, 25 bp, Artificial sequence
  Synthetic oligonucleotide
ggcaacagttatccagaagaccaga

SEQ ID NO: 738820 - DNA, 25 bp, Artificial sequence
  Synthetic oligonucleotide
aggcaacagttatccagaagaccag

SEQ ID NO: 738821 - DNA, 25 bp, Artificial sequence
  Synthetic oligonucleotide
aggcaacagttaaccagaagaccag

SEQ ID NO: 738822 - DNA, 25 bp, Artificial sequence
  Synthetic oligonucleotide
aacagttatccacaagaccagagga

SEQ ID NO: 738823 - DNA, 25 bp, Artificial sequence
  Synthetic oligonucleotide
gaggagacagaatttaatgtaggca

SEQ ID NO: 738824 - DNA, 25 bp, Artificial sequence
  Synthetic oligonucleotide
attaatgtaggctggcaacagttat

SEQ ID NO: 738825 - DNA, 25 bp, Artificial sequence
  Synthetic oligonucleotide
aattaatgtagggaggcaacagtta

SEQ ID NO: 738826 - DNA, 25 bp, Artificial sequence
  Synthetic oligonucleotide
agttgaggagactgaaattaatgta

SEQ ID NO: 738827 - DNA, 25 bp, Artificial sequence
  Synthetic oligonucleotide
gttgaggagacagaaattaatgtag

SEQ ID NO: 738828 - DNA, 25 bp, Artificial sequence
  Synthetic oligonucleotide
gttgaggagacacaaattaatgtag

SEQ ID NO: 738829 - DNA, 25 bp, Artificial sequence
  Synthetic oligonucleotide
ttgaggagacagaaattaatgtagg

SEQ ID NO: 738830 - DNA, 25 bp, Artificial sequence
  Synthetic oligonucleotide
ttgaggagacagtaattaatgtagg

SEQ ID NO: 738831 - DNA, 25 bp, Artificial sequence
  Synthetic oligonucleotide
tgaggagacagaaattaatgtaggc

SEQ ID NO: 738832 - DNA, 25 bp, Artificial sequence
  Synthetic oligonucleotide
agttgaggagacagaaattaatgta

SEQ ID NO: 738833 - DNA, 25 bp, Artificial sequence
  Synthetic oligonucleotide
gaggagacagaaattaatgtaggca

SEQ ID NO: 738834 - DNA, 25 bp, Artificial sequence
  Synthetic oligonucleotide
aggagacagaaaataatgtaggcag

SEQ ID NO: 738835 - DNA, 25 bp, Artificial sequence
  Synthetic oligonucleotide
aggagacagaaattaatgtaggcag

SEQ ID NO: 738836 - DNA, 25 bp, Artificial sequence
  Synthetic oligonucleotide
ggagacagaaattaatgtaggcagg

SEQ ID NO: 738837 - DNA, 25 bp, Artificial sequence
  Synthetic oligonucleotide
ggagacagaaataaatgtaggcagg

SEQ ID NO: 738838 - DNA, 25 bp, Artificial sequence
  Synthetic oligonucleotide
agaaattaatgttggcaggcaacag

SEQ ID NO: 738839 - DNA, 25 bp, Artificial sequence
  Synthetic oligonucleotide
aattaatgtaggcaggcaacagtta

SEQ ID NO: 738840 - DNA, 25 bp, Artificial sequence
  Synthetic oligonucleotide
tgaggagacagatattaatgtaggc

SEQ ID NO: 738841 - DNA, 25 bp, Artificial sequence
  Synthetic oligonucleotide
gacagaaattaatgtaggcaggcaa

SEQ ID NO: 738842 - DNA, 25 bp, Artificial sequence
  Synthetic oligonucleotide
aaattaatgtagccaggcaacagtt

SEQ ID NO: 738843 - DNA, 25 bp, Artificial sequence
  Synthetic oligonucleotide
gaaattaatgtacgcaggcaacagt

SEQ ID NO: 738844 - DNA, 25 bp, Artificial sequence
  Synthetic oligonucleotide
agaaattaatgtaggcaggcaacag

SEQ ID NO: 738845 - DNA, 25 bp, Artificial sequence
  Synthetic oligonucleotide
cagaaattaatgtaggcaggcaaca

SEQ ID NO: 738846 - DNA, 25 bp, Artificial sequence
  Synthetic oligonucleotide
cagaaattaatgaaggcaggcaaca

SEQ ID NO: 738847 - DNA, 25 bp, Artificial sequence
  Synthetic oligonucleotide
acagaaattaatctaggcaggcaac

SEQ ID NO: 738848 - DNA, 25 bp, Artificial sequence
  Synthetic oligonucleotide
acagaaattaatgtaggcaggcaac

SEQ ID NO: 738849 - DNA, 25 bp, Artificial sequence
  Synthetic oligonucleotide
gacagaaattaaagtaggcaggcaa

SEQ ID NO: 738850 - DNA, 25 bp, Artificial sequence
  Synthetic oligonucleotide
gaaattaatgtaggcaggcaacagt

SEQ ID NO: 738851 - DNA, 25 bp, Artificial sequence
  Synthetic oligonucleotide
aatacttgctgtttagggaagcacc

SEQ ID NO: 738852 - DNA, 25 bp, Artificial sequence
  Synthetic oligonucleotide
gctgtatagggaagcaccagccaca

SEQ ID NO: 738853 - DNA, 25 bp, Artificial sequence
  Synthetic oligonucleotide
atacttgctgtatagggaagcacca

SEQ ID NO: 738854 - DNA, 25 bp, Artificial sequence
  Synthetic oligonucleotide
ctgtatagggaagcaccagccacag

SEQ ID NO: 738855 - DNA, 25 bp, Artificial sequence
  Synthetic oligonucleotide
aatacttgctgtatagggaagcacc

SEQ ID NO: 738856 - DNA, 25 bp, Artificial sequence
  Synthetic oligonucleotide
atacttgctgtaaagggaagcacca

SEQ ID NO: 738857 - DNA, 25 bp, Artificial sequence
  Synthetic oligonucleotide
acttgctgtatagggaagcaccagc

SEQ ID NO: 738858 - DNA, 25 bp, Artificial sequence
  Synthetic oligonucleotide
acttgctgtatacggaagcaccagc

SEQ ID NO: 738859 - DNA, 25 bp, Artificial sequence
  Synthetic oligonucleotide
cttgctgtatagcgaagcaccagcc

SEQ ID NO: 738860 - DNA, 25 bp, Artificial sequence
  Synthetic oligonucleotide
cttgctgtatagggaagcaccagcc

SEQ ID NO: 738861 - DNA, 25 bp, Artificial sequence
  Synthetic oligonucleotide
tgctgtatagggaagcaccagccac

SEQ ID NO: 738862 - DNA, 25 bp, Artificial sequence
  Synthetic oligonucleotide
gctgtatagggatgcaccagccaca

SEQ ID NO: 738863 - DNA, 25 bp, Artificial sequence
  Synthetic oligonucleotide
gaatacttgctgtatagggaagcac

SEQ ID NO: 738864 - DNA, 25 bp, Artificial sequence
  Synthetic oligonucleotide
tgctgtatagggtagcaccagccac

SEQ ID NO: 738865 - DNA, 25 bp, Artificial sequence
  Synthetic oligonucleotide
cactgaatacttgctgtatagggaa

SEQ ID NO: 738866 - DNA, 25 bp, Artificial sequence
  Synthetic oligonucleotide
caggacactgaatacttgctgtata

SEQ ID NO: 738867 - DNA, 25 bp, Artificial sequence
  Synthetic oligonucleotide
ggacactgaatagttgctgtatagg

SEQ ID NO: 738868 - DNA, 25 bp, Artificial sequence
  Synthetic oligonucleotide
gggaagcaccagccacagtgaggaa

SEQ ID NO: 738869 - DNA, 25 bp, Artificial sequence
  Synthetic oligonucleotide
gacactgaatacttgctgtataggg

SEQ ID NO: 738870 - DNA, 25 bp, Artificial sequence
  Synthetic oligonucleotide
caggacactgaaaacttgctgtata

SEQ ID NO: 738871 - DNA, 25 bp, Artificial sequence
  Synthetic oligonucleotide
acactgaatactagctgtataggga

SEQ ID NO: 738872 - DNA, 25 bp, Artificial sequence
  Synthetic oligonucleotide
gacactgaatacatgctgtataggg

SEQ ID NO: 738873 - DNA, 25 bp, Artificial sequence
  Synthetic oligonucleotide
cactgaatacttcctgtatagggaa

SEQ ID NO: 738874 - DNA, 25 bp, Artificial sequence
  Synthetic oligonucleotide
gaatacttgctgaatagggaagcac

SEQ ID NO: 738875 - DNA, 25 bp, Artificial sequence
  Synthetic oligonucleotide
actgaatacttggtgtatagggaag

SEQ ID NO: 738876 - DNA, 25 bp, Artificial sequence
  Synthetic oligonucleotide
actgaatacttgctgtatagggaag

SEQ ID NO: 738877 - DNA, 25 bp, Artificial sequence
  Synthetic oligonucleotide
ctgaatacttgcagtatagggaagc

SEQ ID NO: 738878 - DNA, 25 bp, Artificial sequence
  Synthetic oligonucleotide
ctgaatacttgctgtatagggaagc

SEQ ID NO: 738879 - DNA, 25 bp, Artificial sequence
  Synthetic oligonucleotide
tgaatacttgctctatagggaagca

SEQ ID NO: 738880 - DNA, 25 bp, Artificial sequence
  Synthetic oligonucleotide
tgaatacttgctgtatagggaagca

SEQ ID NO: 738881 - DNA, 25 bp, Artificial sequence
  Synthetic oligonucleotide
acactgaatacttgctgtataggga

SEQ ID NO: 738882 - DNA, 25 bp, Artificial sequence
  Synthetic oligonucleotide
ggaagcaccagccacagtgaggaat

SEQ ID NO: 738883 - DNA, 25 bp, Artificial sequence
  Synthetic oligonucleotide
ggacactgaatacttgctgtatagg

SEQ ID NO: 738884 - DNA, 25 bp, Artificial sequence
  Synthetic oligonucleotide
aggacactgaattcttgctgtatag

SEQ ID NO: 738885 - DNA, 25 bp, Artificial sequence
  Synthetic oligonucleotide
aggacactgaatacttgctgtatag

SEQ ID NO: 738886 - DNA, 25 bp, Artificial sequence
  Synthetic oligonucleotide
accagccacagtcaggaatgtccac

SEQ ID NO: 738887 - DNA, 25 bp, Artificial sequence
  Synthetic oligonucleotide
accagccacagtgaggaatgtccac

SEQ ID NO: 738888 - DNA, 25 bp, Artificial sequence
  Synthetic oligonucleotide
caccagccacagtgaggaatgtcca

SEQ ID NO: 738889 - DNA, 25 bp, Artificial sequence
  Synthetic oligonucleotide
caccagccacagagaggaatgtcca

SEQ ID NO: 738890 - DNA, 25 bp, Artificial sequence
  Synthetic oligonucleotide
gcaccagccacagtgaggaatgtcc

SEQ ID NO: 738891 - DNA, 25 bp, Artificial sequence
  Synthetic oligonucleotide
gcaccagccacactgaggaatgtcc

SEQ ID NO: 738892 - DNA, 25 bp, Artificial sequence
  Synthetic oligonucleotide
aagcaccagccacagtgaggaatgt

SEQ ID NO: 738893 - DNA, 25 bp, Artificial sequence
  Synthetic oligonucleotide
aagcaccagccagagtgaggaatgt

SEQ ID NO: 738894 - DNA, 25 bp, Artificial sequence
  Synthetic oligonucleotide
agggaagcaccacccacagtgagga

SEQ ID NO: 738895 - DNA, 25 bp, Artificial sequence
  Synthetic oligonucleotide
gaagcaccagccacagtgaggaatg

SEQ ID NO: 738896 - DNA, 25 bp, Artificial sequence
  Synthetic oligonucleotide
atagggaagcaccagccacagtgag

SEQ ID NO: 738897 - DNA, 25 bp, Artificial sequence
  Synthetic oligonucleotide
tgtatagggaaggaccagccacagt

SEQ ID NO: 738898 - DNA, 25 bp, Artificial sequence
  Synthetic oligonucleotide
tgtatagggaagcaccagccacagt

SEQ ID NO: 738899 - DNA, 25 bp, Artificial sequence
  Synthetic oligonucleotide
gtatagggaagcaccagccacagtg

SEQ ID NO: 738900 - DNA, 25 bp, Artificial sequence
  Synthetic oligonucleotide
gtatagggaagctccagccacagtg

SEQ ID NO: 738901 - DNA, 25 bp, Artificial sequence
  Synthetic oligonucleotide
gaagcaccagcctcagtgaggaatg

SEQ ID NO: 738902 - DNA, 25 bp, Artificial sequence
  Synthetic oligonucleotide
tatagggaagcagcagccacagtga

SEQ ID NO: 738903 - DNA, 25 bp, Artificial sequence
  Synthetic oligonucleotide
ctgtatagggaaccaccagccacag

SEQ ID NO: 738904 - DNA, 25 bp, Artificial sequence
  Synthetic oligonucleotide
atagggaagcacgagccacagtgag

SEQ ID NO: 738905 - DNA, 25 bp, Artificial sequence
  Synthetic oligonucleotide
tagggaagcaccagccacagtgagg

SEQ ID NO: 738906 - DNA, 25 bp, Artificial sequence
  Synthetic oligonucleotide
tagggaagcacctgccacagtgagg

SEQ ID NO: 738907 - DNA, 25 bp, Artificial sequence
  Synthetic oligonucleotide
agggaagcaccagccacagtgagga

SEQ ID NO: 738908 - DNA, 25 bp, Artificial sequence
  Synthetic oligonucleotide
gggaagcaccaggcacagtgaggaa

SEQ ID NO: 738909 - DNA, 25 bp, Artificial sequence
  Synthetic oligonucleotide
ggaagcaccagcgacagtgaggaat

SEQ ID NO: 738910 - DNA, 25 bp, Artificial sequence
  Synthetic oligonucleotide
tatagggaagcaccagccacagtga

SEQ ID NO: 738911 - DNA, 25 bp, Artificial sequence
  Synthetic oligonucleotide
acttgctgtatagggaagcaccagc

SEQ ID NO: 738912 - DNA, 25 bp, Artificial sequence
  Synthetic oligonucleotide
accagccacagtcaggaatgtccac

SEQ ID NO: 738913 - DNA, 25 bp, Artificial sequence
  Synthetic oligonucleotide
tagggaagcacctgccacagtgagg

SEQ ID NO: 738914 - DNA, 25 bp, Artificial sequence
  Synthetic oligonucleotide
cttgctgtatagggaagcaccagcc

SEQ ID NO: 738915 - DNA, 25 bp, Artificial sequence
  Synthetic oligonucleotide
gctgtatagggaagcaccagccaca

SEQ ID NO: 738916 - DNA, 25 bp, Artificial sequence
  Synthetic oligonucleotide
gctgtatagggatgcaccagccaca

SEQ ID NO: 738917 - DNA, 25 bp, Artificial sequence
  Synthetic oligonucleotide
ctgtatagggaagcaccagccacag

SEQ ID NO: 738918 - DNA, 25 bp, Artificial sequence
  Synthetic oligonucleotide
ctgtatagggaaccaccagccacag

SEQ ID NO: 738919 - DNA, 25 bp, Artificial sequence
  Synthetic oligonucleotide
tgtatagggaagcaccagccacagt

SEQ ID NO: 738920 - DNA, 25 bp, Artificial sequence
  Synthetic oligonucleotide
tgtatagggaaggaccagccacagt

SEQ ID NO: 738921 - DNA, 25 bp, Artificial sequence
  Synthetic oligonucleotide
gtatagggaagctccagccacagtg

SEQ ID NO: 738922 - DNA, 25 bp, Artificial sequence
  Synthetic oligonucleotide
gtatagggaagcaccagccacagtg

SEQ ID NO: 738923 - DNA, 25 bp, Artificial sequence
  Synthetic oligonucleotide
tatagggaagcaccagccacagtga

SEQ ID NO: 738924 - DNA, 25 bp, Artificial sequence
  Synthetic oligonucleotide
tatagggaagcagcagccacagtga

SEQ ID NO: 738925 - DNA, 25 bp, Artificial sequence
  Synthetic oligonucleotide
atagggaagcacgagccacagtgag

SEQ ID NO: 738926 - DNA, 25 bp, Artificial sequence
  Synthetic oligonucleotide
tgctgtatagggtagcaccagccac

SEQ ID NO: 738927 - DNA, 25 bp, Artificial sequence
  Synthetic oligonucleotide
tagggaagcaccagccacagtgagg

SEQ ID NO: 738928 - DNA, 25 bp, Artificial sequence
  Synthetic oligonucleotide
cttgctgtatagcgaagcaccagcc

SEQ ID NO: 738929 - DNA, 25 bp, Artificial sequence
  Synthetic oligonucleotide
agggaagcaccacccacagtgagga

SEQ ID NO: 738930 - DNA, 25 bp, Artificial sequence
  Synthetic oligonucleotide
agggaagcaccagccacagtgagga

SEQ ID NO: 738931 - DNA, 25 bp, Artificial sequence
  Synthetic oligonucleotide
gggaagcaccaggcacagtgaggaa

SEQ ID NO: 738932 - DNA, 25 bp, Artificial sequence
  Synthetic oligonucleotide
gggaagcaccagccacagtgaggaa

SEQ ID NO: 738933 - DNA, 25 bp, Artificial sequence
  Synthetic oligonucleotide
ggaagcaccagcgacagtgaggaat

SEQ ID NO: 738934 - DNA, 25 bp, Artificial sequence
  Synthetic oligonucleotide
ggaagcaccagccacagtgaggaat

SEQ ID NO: 738935 - DNA, 25 bp, Artificial sequence
  Synthetic oligonucleotide
gaagcaccagcctcagtgaggaatg

SEQ ID NO: 738936 - DNA, 25 bp, Artificial sequence
  Synthetic oligonucleotide
gaagcaccagccacagtgaggaatg

SEQ ID NO: 738937 - DNA, 25 bp, Artificial sequence
  Synthetic oligonucleotide
aagcaccagccagagtgaggaatgt

SEQ ID NO: 738938 - DNA, 25 bp, Artificial sequence
  Synthetic oligonucleotide
aagcaccagccacagtgaggaatgt

SEQ ID NO: 738939 - DNA, 25 bp, Artificial sequence
  Synthetic oligonucleotide
gcaccagccacagtgaggaatgtcc

SEQ ID NO: 738940 - DNA, 25 bp, Artificial sequence
  Synthetic oligonucleotide
gcaccagccacactgaggaatgtcc

SEQ ID NO: 738941 - DNA, 25 bp, Artificial sequence
  Synthetic oligonucleotide
accagccacagtgaggaatgtccac

SEQ ID NO: 738942 - DNA, 25 bp, Artificial sequence
  Synthetic oligonucleotide
atagggaagcaccagccacagtgag

SEQ ID NO: 738943 - DNA, 25 bp, Artificial sequence
  Synthetic oligonucleotide
actgaatacttggtgtatagggaag

SEQ ID NO: 738944 - DNA, 25 bp, Artificial sequence
  Synthetic oligonucleotide
caccagccacagtgaggaatgtcca

SEQ ID NO: 738945 - DNA, 25 bp, Artificial sequence
  Synthetic oligonucleotide
caggacactgaaaacttgctgtata

SEQ ID NO: 738946 - DNA, 25 bp, Artificial sequence
  Synthetic oligonucleotide
caggacactgaatacttgctgtata

SEQ ID NO: 738947 - DNA, 25 bp, Artificial sequence
  Synthetic oligonucleotide
aggacactgaattcttgctgtatag

SEQ ID NO: 738948 - DNA, 25 bp, Artificial sequence
  Synthetic oligonucleotide
aggacactgaatacttgctgtatag

SEQ ID NO: 738949 - DNA, 25 bp, Artificial sequence
  Synthetic oligonucleotide
ggacactgaatagttgctgtatagg

SEQ ID NO: 738950 - DNA, 25 bp, Artificial sequence
  Synthetic oligonucleotide
ggacactgaatacttgctgtatagg

SEQ ID NO: 738951 - DNA, 25 bp, Artificial sequence
  Synthetic oligonucleotide
gacactgaatacatgctgtataggg

SEQ ID NO: 738952 - DNA, 25 bp, Artificial sequence
  Synthetic oligonucleotide
gacactgaatacttgctgtataggg

SEQ ID NO: 738953 - DNA, 25 bp, Artificial sequence
  Synthetic oligonucleotide
acactgaatactagctgtataggga

SEQ ID NO: 738954 - DNA, 25 bp, Artificial sequence
  Synthetic oligonucleotide
acactgaatacttgctgtataggga

SEQ ID NO: 738955 - DNA, 25 bp, Artificial sequence
  Synthetic oligonucleotide
tgctgtatagggaagcaccagccac

SEQ ID NO: 738956 - DNA, 25 bp, Artificial sequence
  Synthetic oligonucleotide
cactgaatacttgctgtatagggaa

SEQ ID NO: 738957 - DNA, 25 bp, Artificial sequence
  Synthetic oligonucleotide
caccagccacagagaggaatgtcca

SEQ ID NO: 738958 - DNA, 25 bp, Artificial sequence
  Synthetic oligonucleotide
acttgctgtatacggaagcaccagc

SEQ ID NO: 738959 - DNA, 25 bp, Artificial sequence
  Synthetic oligonucleotide
atacttgctgtatagggaagcacca

SEQ ID NO: 738960 - DNA, 25 bp, Artificial sequence
  Synthetic oligonucleotide
atacttgctgtaaagggaagcacca

SEQ ID NO: 738961 - DNA, 25 bp, Artificial sequence
  Synthetic oligonucleotide
aatacttgctgtatagggaagcacc

SEQ ID NO: 738962 - DNA, 25 bp, Artificial sequence
  Synthetic oligonucleotide
cactgaatacttcctgtatagggaa

SEQ ID NO: 738963 - DNA, 25 bp, Artificial sequence
  Synthetic oligonucleotide
gaatacttgctgtatagggaagcac

SEQ ID NO: 738964 - DNA, 25 bp, Artificial sequence
  Synthetic oligonucleotide
gaatacttgctgaatagggaagcac

SEQ ID NO: 738965 - DNA, 25 bp, Artificial sequence
  Synthetic oligonucleotide
tgaatacttgctgtatagggaagca

SEQ ID NO: 738966 - DNA, 25 bp, Artificial sequence
  Synthetic oligonucleotide
tgaatacttgctctatagggaagca

SEQ ID NO: 738967 - DNA, 25 bp, Artificial sequence
  Synthetic oligonucleotide
ctgaatacttgctgtatagggaagc

SEQ ID NO: 738968 - DNA, 25 bp, Artificial sequence
  Synthetic oligonucleotide
ctgaatacttgcagtatagggaagc

SEQ ID NO: 738969 - DNA, 25 bp, Artificial sequence
  Synthetic oligonucleotide
actgaatacttgctgtatagggaag

SEQ ID NO: 738970 - DNA, 25 bp, Artificial sequence
  Synthetic oligonucleotide
aatacttgctgtttagggaagcacc

SEQ ID NO: 738971 - DNA, 25 bp, Artificial sequence
  Synthetic oligonucleotide
atgagggcagagctgaccatctgga

SEQ ID NO: 738972 - DNA, 25 bp, Artificial sequence
  Synthetic oligonucleotide
tgaatgagggcagagctgaccatct

SEQ ID NO: 738973 - DNA, 25 bp, Artificial sequence
  Synthetic oligonucleotide
tgaatgagggcacagctgaccatct

SEQ ID NO: 738974 - DNA, 25 bp, Artificial sequence
  Synthetic oligonucleotide
gacggacacagtgatttctatggaa

SEQ ID NO: 738975 - DNA, 25 bp, Artificial sequence
  Synthetic oligonucleotide
aatgagggcagagctgaccatctgg

SEQ ID NO: 738976 - DNA, 25 bp, Artificial sequence
  Synthetic oligonucleotide
ccatctggacggtcacagtgatttc

SEQ ID NO: 738977 - DNA, 25 bp, Artificial sequence
  Synthetic oligonucleotide
catctggacggagacagtgatttct

SEQ ID NO: 738978 - DNA, 25 bp, Artificial sequence
  Synthetic oligonucleotide
catctggacggacacagtgatttct

SEQ ID NO: 738979 - DNA, 25 bp, Artificial sequence
  Synthetic oligonucleotide
atctggacggactcagtgatttcta

SEQ ID NO: 738980 - DNA, 25 bp, Artificial sequence
  Synthetic oligonucleotide
atctggacggacacagtgatttcta

SEQ ID NO: 738981 - DNA, 25 bp, Artificial sequence
  Synthetic oligonucleotide
tctggacggacagagtgatttctat

SEQ ID NO: 738982 - DNA, 25 bp, Artificial sequence
  Synthetic oligonucleotide
tctggacggacacagtgatttctat

SEQ ID NO: 738983 - DNA, 25 bp, Artificial sequence
  Synthetic oligonucleotide
ctggacggacactgtgatttctatg

SEQ ID NO: 738984 - DNA, 25 bp, Artificial sequence
  Synthetic oligonucleotide
ctggacggacacagtgatttctatg

SEQ ID NO: 738985 - DNA, 25 bp, Artificial sequence
  Synthetic oligonucleotide
tggacggacacagtgatttctatgg

SEQ ID NO: 738986 - DNA, 25 bp, Artificial sequence
  Synthetic oligonucleotide
tggacggacacactgatttctatgg

SEQ ID NO: 738987 - DNA, 25 bp, Artificial sequence
  Synthetic oligonucleotide
cacagtgatttcaatggaaggcttg

SEQ ID NO: 738988 - DNA, 25 bp, Artificial sequence
  Synthetic oligonucleotide
ggacggacacagagatttctatgga

SEQ ID NO: 738989 - DNA, 25 bp, Artificial sequence
  Synthetic oligonucleotide
ccatctggacggacacagtgatttc

SEQ ID NO: 738990 - DNA, 25 bp, Artificial sequence
  Synthetic oligonucleotide
gacggacacagtcatttctatggaa

SEQ ID NO: 738991 - DNA, 25 bp, Artificial sequence
  Synthetic oligonucleotide
acggacacagtgttttctatggaag

SEQ ID NO: 738992 - DNA, 25 bp, Artificial sequence
  Synthetic oligonucleotide
acggacacagtgatttctatggaag

SEQ ID NO: 738993 - DNA, 25 bp, Artificial sequence
  Synthetic oligonucleotide
cggacacagtgatttctatggaagg

SEQ ID NO: 738994 - DNA, 25 bp, Artificial sequence
  Synthetic oligonucleotide
cggacacagtgaattctatggaagg

SEQ ID NO: 738995 - DNA, 25 bp, Artificial sequence
  Synthetic oligonucleotide
ggacacagtgatatctatggaaggc

SEQ ID NO: 738996 - DNA, 25 bp, Artificial sequence
  Synthetic oligonucleotide
ggacacagtgatttctatggaaggc

SEQ ID NO: 738997 - DNA, 25 bp, Artificial sequence
  Synthetic oligonucleotide
gacacagtgattactatggaaggct

SEQ ID NO: 738998 - DNA, 25 bp, Artificial sequence
  Synthetic oligonucleotide
gacacagtgatttctatggaaggct

SEQ ID NO: 738999 - DNA, 25 bp, Artificial sequence
  Synthetic oligonucleotide
acacagtgatttgtatggaaggctt

SEQ ID NO: 739000 - DNA, 25 bp, Artificial sequence
  Synthetic oligonucleotide
acacagtgatttctatggaaggctt

SEQ ID NO: 739001 - DNA, 25 bp, Artificial sequence
  Synthetic oligonucleotide
cacagtgatttctatggaaggcttg

SEQ ID NO: 739002 - DNA, 25 bp, Artificial sequence
  Synthetic oligonucleotide
ggacggacacagtgatttctatgga

SEQ ID NO: 739003 - DNA, 25 bp, Artificial sequence
  Synthetic oligonucleotide
agagctgaccatgtggacggacaca

SEQ ID NO: 739004 - DNA, 25 bp, Artificial sequence
  Synthetic oligonucleotide
atgagggcagaggtgaccatctgga

SEQ ID NO: 739005 - DNA, 25 bp, Artificial sequence
  Synthetic oligonucleotide
tgagggcagagctgaccatctggac

SEQ ID NO: 739006 - DNA, 25 bp, Artificial sequence
  Synthetic oligonucleotide
tgagggcagagcagaccatctggac

SEQ ID NO: 739007 - DNA, 25 bp, Artificial sequence
  Synthetic oligonucleotide
gagggcagagctcaccatctggacg

SEQ ID NO: 739008 - DNA, 25 bp, Artificial sequence
  Synthetic oligonucleotide
gagggcagagctgaccatctggacg

SEQ ID NO: 739009 - DNA, 25 bp, Artificial sequence
  Synthetic oligonucleotide
gggcagagctgaccatctggacgga

SEQ ID NO: 739010 - DNA, 25 bp, Artificial sequence
  Synthetic oligonucleotide
gggcagagctgagcatctggacgga

SEQ ID NO: 739011 - DNA, 25 bp, Artificial sequence
  Synthetic oligonucleotide
ggcagagctgaccatctggacggac

SEQ ID NO: 739012 - DNA, 25 bp, Artificial sequence
  Synthetic oligonucleotide
ggcagagctgacgatctggacggac

SEQ ID NO: 739013 - DNA, 25 bp, Artificial sequence
  Synthetic oligonucleotide
gcagagctgaccttctggacggaca

SEQ ID NO: 739014 - DNA, 25 bp, Artificial sequence
  Synthetic oligonucleotide
gcagagctgaccatctggacggaca

SEQ ID NO: 739015 - DNA, 25 bp, Artificial sequence
  Synthetic oligonucleotide
cagagctgaccaactggacggacac

SEQ ID NO: 739016 - DNA, 25 bp, Artificial sequence
  Synthetic oligonucleotide
agagctgaccatctggacggacaca

SEQ ID NO: 739017 - DNA, 25 bp, Artificial sequence
  Synthetic oligonucleotide
aatgagggcagacctgaccatctgg

SEQ ID NO: 739018 - DNA, 25 bp, Artificial sequence
  Synthetic oligonucleotide
gagctgaccatctggacggacacag

SEQ ID NO: 739019 - DNA, 25 bp, Artificial sequence
  Synthetic oligonucleotide
gagctgaccatcaggacggacacag

SEQ ID NO: 739020 - DNA, 25 bp, Artificial sequence
  Synthetic oligonucleotide
agctgaccatctggacggacacagt

SEQ ID NO: 739021 - DNA, 25 bp, Artificial sequence
  Synthetic oligonucleotide
agctgaccatctcgacggacacagt

SEQ ID NO: 739022 - DNA, 25 bp, Artificial sequence
  Synthetic oligonucleotide
gctgaccatctggacggacacagtg

SEQ ID NO: 739023 - DNA, 25 bp, Artificial sequence
  Synthetic oligonucleotide
gctgaccatctgcacggacacagtg

SEQ ID NO: 739024 - DNA, 25 bp, Artificial sequence
  Synthetic oligonucleotide
tgaccatctggacggacacagtgat

SEQ ID NO: 739025 - DNA, 25 bp, Artificial sequence
  Synthetic oligonucleotide
tgaccatctggagggacacagtgat

SEQ ID NO: 739026 - DNA, 25 bp, Artificial sequence
  Synthetic oligonucleotide
gaccatctggacggacacagtgatt

SEQ ID NO: 739027 - DNA, 25 bp, Artificial sequence
  Synthetic oligonucleotide
gaccatctggaccgacacagtgatt

SEQ ID NO: 739028 - DNA, 25 bp, Artificial sequence
  Synthetic oligonucleotide
accatctggacgcacacagtgattt

SEQ ID NO: 739029 - DNA, 25 bp, Artificial sequence
  Synthetic oligonucleotide
accatctggacggacacagtgattt

SEQ ID NO: 739030 - DNA, 25 bp, Artificial sequence
  Synthetic oligonucleotide
cagagctgaccatctggacggacac

SEQ ID NO: 739031 - DNA, 25 bp, Artificial sequence
  Synthetic oligonucleotide
gctgaccatctggacggacacagtg

SEQ ID NO: 739032 - DNA, 25 bp, Artificial sequence
  Synthetic oligonucleotide
gggcagagctgaccatctggacgga

SEQ ID NO: 739033 - DNA, 25 bp, Artificial sequence
  Synthetic oligonucleotide
gaccatctggaccgacacagtgatt

SEQ ID NO: 739034 - DNA, 25 bp, Artificial sequence
  Synthetic oligonucleotide
tgaccatctggagggacacagtgat

SEQ ID NO: 739035 - DNA, 25 bp, Artificial sequence
  Synthetic oligonucleotide
tgaatgagggcacagctgaccatct

SEQ ID NO: 739036 - DNA, 25 bp, Artificial sequence
  Synthetic oligonucleotide
gctgaccatctgcacggacacagtg

SEQ ID NO: 739037 - DNA, 25 bp, Artificial sequence
  Synthetic oligonucleotide
agctgaccatctcgacggacacagt

SEQ ID NO: 739038 - DNA, 25 bp, Artificial sequence
  Synthetic oligonucleotide
agctgaccatctggacggacacagt

SEQ ID NO: 739039 - DNA, 25 bp, Artificial sequence
  Synthetic oligonucleotide
gagctgaccatcaggacggacacag

SEQ ID NO: 739040 - DNA, 25 bp, Artificial sequence
  Synthetic oligonucleotide
gagctgaccatctggacggacacag

SEQ ID NO: 739041 - DNA, 25 bp, Artificial sequence
  Synthetic oligonucleotide
agagctgaccatctggacggacaca

SEQ ID NO: 739042 - DNA, 25 bp, Artificial sequence
  Synthetic oligonucleotide
agagctgaccatgtggacggacaca

SEQ ID NO: 739043 - DNA, 25 bp, Artificial sequence
  Synthetic oligonucleotide
cagagctgaccatctggacggacac

SEQ ID NO: 739044 - DNA, 25 bp, Artificial sequence
  Synthetic oligonucleotide
cagagctgaccaactggacggacac

SEQ ID NO: 739045 - DNA, 25 bp, Artificial sequence
  Synthetic oligonucleotide
gaccatctggacggacacagtgatt

SEQ ID NO: 739046 - DNA, 25 bp, Artificial sequence
  Synthetic oligonucleotide
ggcagagctgaccatctggacggac

SEQ ID NO: 739047 - DNA, 25 bp, Artificial sequence
  Synthetic oligonucleotide
gcagagctgaccatctggacggaca

SEQ ID NO: 739048 - DNA, 25 bp, Artificial sequence
  Synthetic oligonucleotide
gggcagagctgagcatctggacgga

SEQ ID NO: 739049 - DNA, 25 bp, Artificial sequence
  Synthetic oligonucleotide
gagggcagagctcaccatctggacg

SEQ ID NO: 739050 - DNA, 25 bp, Artificial sequence
  Synthetic oligonucleotide
gagggcagagctgaccatctggacg

SEQ ID NO: 739051 - DNA, 25 bp, Artificial sequence
  Synthetic oligonucleotide
tgagggcagagctgaccatctggac

SEQ ID NO: 739052 - DNA, 25 bp, Artificial sequence
  Synthetic oligonucleotide
tgagggcagagcagaccatctggac

SEQ ID NO: 739053 - DNA, 25 bp, Artificial sequence
  Synthetic oligonucleotide
atgagggcagagctgaccatctgga

SEQ ID NO: 739054 - DNA, 25 bp, Artificial sequence
  Synthetic oligonucleotide
atgagggcagaggtgaccatctgga

SEQ ID NO: 739055 - DNA, 25 bp, Artificial sequence
  Synthetic oligonucleotide
aatgagggcagagctgaccatctgg

SEQ ID NO: 739056 - DNA, 25 bp, Artificial sequence
  Synthetic oligonucleotide
aatgagggcagacctgaccatctgg

SEQ ID NO: 739057 - DNA, 25 bp, Artificial sequence
  Synthetic oligonucleotide
tgaatgagggcagagctgaccatct

SEQ ID NO: 739058 - DNA, 25 bp, Artificial sequence
  Synthetic oligonucleotide
cacagtgatttcaatggaaggcttg

SEQ ID NO: 739059 - DNA, 25 bp, Artificial sequence
  Synthetic oligonucleotide
tgaccatctggacggacacagtgat

SEQ ID NO: 739060 - DNA, 25 bp, Artificial sequence
  Synthetic oligonucleotide
gcagagctgaccttctggacggaca

SEQ ID NO: 739061 - DNA, 25 bp, Artificial sequence
  Synthetic oligonucleotide
acggacacagtgttttctatggaag

SEQ ID NO: 739062 - DNA, 25 bp, Artificial sequence
  Synthetic oligonucleotide
cacagtgatttctatggaaggcttg

SEQ ID NO: 739063 - DNA, 25 bp, Artificial sequence
  Synthetic oligonucleotide
ggcagagctgacgatctggacggac

SEQ ID NO: 739064 - DNA, 25 bp, Artificial sequence
  Synthetic oligonucleotide
accatctggacgcacacagtgattt

SEQ ID NO: 739065 - DNA, 25 bp, Artificial sequence
  Synthetic oligonucleotide
acacagtgatttgtatggaaggctt

SEQ ID NO: 739066 - DNA, 25 bp, Artificial sequence
  Synthetic oligonucleotide
gacacagtgatttctatggaaggct

SEQ ID NO: 739067 - DNA, 25 bp, Artificial sequence
  Synthetic oligonucleotide
gacacagtgattactatggaaggct

SEQ ID NO: 739068 - DNA, 25 bp, Artificial sequence
  Synthetic oligonucleotide
ggacacagtgatatctatggaaggc

SEQ ID NO: 739069 - DNA, 25 bp, Artificial sequence
  Synthetic oligonucleotide
ggacacagtgatttctatggaaggc

SEQ ID NO: 739070 - DNA, 25 bp, Artificial sequence
  Synthetic oligonucleotide
cggacacagtgaattctatggaagg

SEQ ID NO: 739071 - DNA, 25 bp, Artificial sequence
  Synthetic oligonucleotide
acacagtgatttctatggaaggctt

SEQ ID NO: 739072 - DNA, 25 bp, Artificial sequence
  Synthetic oligonucleotide
acggacacagtgatttctatggaag

SEQ ID NO: 739073 - DNA, 25 bp, Artificial sequence
  Synthetic oligonucleotide
gacggacacagtcatttctatggaa

SEQ ID NO: 739074 - DNA, 25 bp, Artificial sequence
  Synthetic oligonucleotide
gacggacacagtgatttctatggaa

SEQ ID NO: 739075 - DNA, 25 bp, Artificial sequence
  Synthetic oligonucleotide
ggacggacacagagatttctatgga

SEQ ID NO: 739076 - DNA, 25 bp, Artificial sequence
  Synthetic oligonucleotide
catctggacggacacagtgatttct

SEQ ID NO: 739077 - DNA, 25 bp, Artificial sequence
  Synthetic oligonucleotide
accatctggacggacacagtgattt

SEQ ID NO: 739078 - DNA, 25 bp, Artificial sequence
  Synthetic oligonucleotide
ccatctggacggacacagtgatttc

SEQ ID NO: 739079 - DNA, 25 bp, Artificial sequence
  Synthetic oligonucleotide
cggacacagtgatttctatggaagg

SEQ ID NO: 739080 - DNA, 25 bp, Artificial sequence
  Synthetic oligonucleotide
ccatctggacggtcacagtgatttc

SEQ ID NO: 739081 - DNA, 25 bp, Artificial sequence
  Synthetic oligonucleotide
ggacggacacagtgatttctatgga

SEQ ID NO: 739082 - DNA, 25 bp, Artificial sequence
  Synthetic oligonucleotide
catctggacggagacagtgatttct

SEQ ID NO: 739083 - DNA, 25 bp, Artificial sequence
  Synthetic oligonucleotide
atctggacggactcagtgatttcta

SEQ ID NO: 739084 - DNA, 25 bp, Artificial sequence
  Synthetic oligonucleotide
atctggacggacacagtgatttcta

SEQ ID NO: 739085 - DNA, 25 bp, Artificial sequence
  Synthetic oligonucleotide
tctggacggacagagtgatttctat

SEQ ID NO: 739086 - DNA, 25 bp, Artificial sequence
  Synthetic oligonucleotide
ctggacggacactgtgatttctatg

SEQ ID NO: 739087 - DNA, 25 bp, Artificial sequence
  Synthetic oligonucleotide
ctggacggacacagtgatttctatg

SEQ ID NO: 739088 - DNA, 25 bp, Artificial sequence
  Synthetic oligonucleotide
tggacggacacactgatttctatgg

SEQ ID NO: 739089 - DNA, 25 bp, Artificial sequence
  Synthetic oligonucleotide
tggacggacacagtgatttctatgg

SEQ ID NO: 739090 - DNA, 25 bp, Artificial sequence
  Synthetic oligonucleotide
tctggacggacacagtgatttctat

SEQ ID NO: 739091 - DNA, 25 bp, Artificial sequence
  Synthetic oligonucleotide
ccctctctcatgttggaagtggcag

SEQ ID NO: 739092 - DNA, 25 bp, Artificial sequence
  Synthetic oligonucleotide
gaggcccctctctcatgttggaagt

SEQ ID NO: 739093 - DNA, 25 bp, Artificial sequence
  Synthetic oligonucleotide
aggcccctctctgatgttggaagtg

SEQ ID NO: 739094 - DNA, 25 bp, Artificial sequence
  Synthetic oligonucleotide
aggcccctctctcatgttggaagtg

SEQ ID NO: 739095 - DNA, 25 bp, Artificial sequence
  Synthetic oligonucleotide
ggcccctctctcatgttggaagtgg

SEQ ID NO: 739096 - DNA, 25 bp, Artificial sequence
  Synthetic oligonucleotide
ggcccctctctcttgttggaagtgg

SEQ ID NO: 739097 - DNA, 25 bp, Artificial sequence
  Synthetic oligonucleotide
gcccctctctcaagttggaagtggc

SEQ ID NO: 739098 - DNA, 25 bp, Artificial sequence
  Synthetic oligonucleotide
gcccctctctcatgttggaagtggc

SEQ ID NO: 739099 - DNA, 25 bp, Artificial sequence
  Synthetic oligonucleotide
ccctctctcatgatggaagtggcag

SEQ ID NO: 739100 - DNA, 25 bp, Artificial sequence
  Synthetic oligonucleotide
cccctctctcatgttggaagtggca

SEQ ID NO: 739101 - DNA, 25 bp, Artificial sequence
  Synthetic oligonucleotide
cctctctcatgtaggaagtggcagc

SEQ ID NO: 739102 - DNA, 25 bp, Artificial sequence
  Synthetic oligonucleotide
cctctctcatgttggaagtggcagc

SEQ ID NO: 739103 - DNA, 25 bp, Artificial sequence
  Synthetic oligonucleotide
gaggcccctctcacatgttggaagt

SEQ ID NO: 739104 - DNA, 25 bp, Artificial sequence
  Synthetic oligonucleotide
cccctctctcatcttggaagtggca

SEQ ID NO: 739105 - DNA, 25 bp, Artificial sequence
  Synthetic oligonucleotide
tgctgaggaggcccctctctcatgt

SEQ ID NO: 739106 - DNA, 25 bp, Artificial sequence
  Synthetic oligonucleotide
ggcagcgacgtttggggctgatccc

SEQ ID NO: 739107 - DNA, 25 bp, Artificial sequence
  Synthetic oligonucleotide
ctctctcatgttggaagtggcagcg

SEQ ID NO: 739108 - DNA, 25 bp, Artificial sequence
  Synthetic oligonucleotide
cattgctgaggaggcccctctctca

SEQ ID NO: 739109 - DNA, 25 bp, Artificial sequence
  Synthetic oligonucleotide
attgctgaggagccccctctctcat

SEQ ID NO: 739110 - DNA, 25 bp, Artificial sequence
  Synthetic oligonucleotide
attgctgaggaggcccctctctcat

SEQ ID NO: 739111 - DNA, 25 bp, Artificial sequence
  Synthetic oligonucleotide
cattgctgaggacgcccctctctca

SEQ ID NO: 739112 - DNA, 25 bp, Artificial sequence
  Synthetic oligonucleotide
ttgctgaggagggccctctctcatg

SEQ ID NO: 739113 - DNA, 25 bp, Artificial sequence
  Synthetic oligonucleotide
ggaggcccctctctcatgttggaag

SEQ ID NO: 739114 - DNA, 25 bp, Artificial sequence
  Synthetic oligonucleotide
tgctgaggaggcgcctctctcatgt

SEQ ID NO: 739115 - DNA, 25 bp, Artificial sequence
  Synthetic oligonucleotide
gaggaggcccctctctcatgttgga

SEQ ID NO: 739116 - DNA, 25 bp, Artificial sequence
  Synthetic oligonucleotide
gaggaggcccctgtctcatgttgga

SEQ ID NO: 739117 - DNA, 25 bp, Artificial sequence
  Synthetic oligonucleotide
aggaggcccctcactcatgttggaa

SEQ ID NO: 739118 - DNA, 25 bp, Artificial sequence
  Synthetic oligonucleotide
aggaggcccctctctcatgttggaa

SEQ ID NO: 739119 - DNA, 25 bp, Artificial sequence
  Synthetic oligonucleotide
ggaggcccctctgtcatgttggaag

SEQ ID NO: 739120 - DNA, 25 bp, Artificial sequence
  Synthetic oligonucleotide
ttgctgaggaggcccctctctcatg

SEQ ID NO: 739121 - DNA, 25 bp, Artificial sequence
  Synthetic oligonucleotide
tgttggaagtgggagcgacgtttgg

SEQ ID NO: 739122 - DNA, 25 bp, Artificial sequence
  Synthetic oligonucleotide
ggcagcgacgttaggggctgatccc

SEQ ID NO: 739123 - DNA, 25 bp, Artificial sequence
  Synthetic oligonucleotide
tggcagcgacgtttggggctgatcc

SEQ ID NO: 739124 - DNA, 25 bp, Artificial sequence
  Synthetic oligonucleotide
agtggcagcgacctttggggctgat

SEQ ID NO: 739125 - DNA, 25 bp, Artificial sequence
  Synthetic oligonucleotide
agtggcagcgacgtttggggctgat

SEQ ID NO: 739126 - DNA, 25 bp, Artificial sequence
  Synthetic oligonucleotide
aagtggcagcgaggtttggggctga

SEQ ID NO: 739127 - DNA, 25 bp, Artificial sequence
  Synthetic oligonucleotide
aagtggcagcgacgtttggggctga

SEQ ID NO: 739128 - DNA, 25 bp, Artificial sequence
  Synthetic oligonucleotide
ggaagtggcagccacgtttggggct

SEQ ID NO: 739129 - DNA, 25 bp, Artificial sequence
  Synthetic oligonucleotide
ggaagtggcagcgacgtttggggct

SEQ ID NO: 739130 - DNA, 25 bp, Artificial sequence
  Synthetic oligonucleotide
tggaagtggcagggacgtttggggc

SEQ ID NO: 739131 - DNA, 25 bp, Artificial sequence
  Synthetic oligonucleotide
tggaagtggcagcgacgtttggggc

SEQ ID NO: 739132 - DNA, 25 bp, Artificial sequence
  Synthetic oligonucleotide
ttggaagtggcaccgacgtttgggg

SEQ ID NO: 739133 - DNA, 25 bp, Artificial sequence
  Synthetic oligonucleotide
ttggaagtggcagcgacgtttgggg

SEQ ID NO: 739134 - DNA, 25 bp, Artificial sequence
  Synthetic oligonucleotide
tggcagcgacgtatggggctgatcc

SEQ ID NO: 739135 - DNA, 25 bp, Artificial sequence
  Synthetic oligonucleotide
gttggaagtggctgcgacgtttggg

SEQ ID NO: 739136 - DNA, 25 bp, Artificial sequence
  Synthetic oligonucleotide
ctcatgttggaactggcagcgacgt

SEQ ID NO: 739137 - DNA, 25 bp, Artificial sequence
  Synthetic oligonucleotide
tctctcatgttggaagtggcagcga

SEQ ID NO: 739138 - DNA, 25 bp, Artificial sequence
  Synthetic oligonucleotide
tctctcatgttgcaagtggcagcga

SEQ ID NO: 739139 - DNA, 25 bp, Artificial sequence
  Synthetic oligonucleotide
ctctcatgttggtagtggcagcgac

SEQ ID NO: 739140 - DNA, 25 bp, Artificial sequence
  Synthetic oligonucleotide
ctctcatgttggaagtggcagcgac

SEQ ID NO: 739141 - DNA, 25 bp, Artificial sequence
  Synthetic oligonucleotide
gttggaagtggcagcgacgtttggg

SEQ ID NO: 739142 - DNA, 25 bp, Artificial sequence
  Synthetic oligonucleotide
tctcatgttggatgtggcagcgacg

SEQ ID NO: 739143 - DNA, 25 bp, Artificial sequence
  Synthetic oligonucleotide
ctctctcatgttcgaagtggcagcg

SEQ ID NO: 739144 - DNA, 25 bp, Artificial sequence
  Synthetic oligonucleotide
ctcatgttggaagtggcagcgacgt

SEQ ID NO: 739145 - DNA, 25 bp, Artificial sequence
  Synthetic oligonucleotide
tcatgttggaagtggcagcgacgtt

SEQ ID NO: 739146 - DNA, 25 bp, Artificial sequence
  Synthetic oligonucleotide
tcatgttggaagaggcagcgacgtt

SEQ ID NO: 739147 - DNA, 25 bp, Artificial sequence
  Synthetic oligonucleotide
catgttggaagtggcagcgacgttt

SEQ ID NO: 739148 - DNA, 25 bp, Artificial sequence
  Synthetic oligonucleotide
catgttggaagtcgcagcgacgttt

SEQ ID NO: 739149 - DNA, 25 bp, Artificial sequence
  Synthetic oligonucleotide
tgttggaagtggcagcgacgtttgg

SEQ ID NO: 739150 - DNA, 25 bp, Artificial sequence
  Synthetic oligonucleotide
tctcatgttggaagtggcagcgacg

SEQ ID NO: 739151 - DNA, 25 bp, Artificial sequence
  Synthetic oligonucleotide
agtggcagcgacgtttggggctgat

SEQ ID NO: 739152 - DNA, 25 bp, Artificial sequence
  Synthetic oligonucleotide
tgttggaagtggcagcgacgtttgg

SEQ ID NO: 739153 - DNA, 25 bp, Artificial sequence
  Synthetic oligonucleotide
tggcagcgacgtatggggctgatcc

SEQ ID NO: 739154 - DNA, 25 bp, Artificial sequence
  Synthetic oligonucleotide
tctctcatgttggaagtggcagcga

SEQ ID NO: 739155 - DNA, 25 bp, Artificial sequence
  Synthetic oligonucleotide
tctctcatgttgcaagtggcagcga

SEQ ID NO: 739156 - DNA, 25 bp, Artificial sequence
  Synthetic oligonucleotide
ctctcatgttggaagtggcagcgac

SEQ ID NO: 739157 - DNA, 25 bp, Artificial sequence
  Synthetic oligonucleotide
ctctcatgttggtagtggcagcgac

SEQ ID NO: 739158 - DNA, 25 bp, Artificial sequence
  Synthetic oligonucleotide
tctcatgttggaagtggcagcgacg

SEQ ID NO: 739159 - DNA, 25 bp, Artificial sequence
  Synthetic oligonucleotide
tctcatgttggatgtggcagcgacg

SEQ ID NO: 739160 - DNA, 25 bp, Artificial sequence
  Synthetic oligonucleotide
ctcatgttggaagtggcagcgacgt

SEQ ID NO: 739161 - DNA, 25 bp, Artificial sequence
  Synthetic oligonucleotide
ctcatgttggaactggcagcgacgt

SEQ ID NO: 739162 - DNA, 25 bp, Artificial sequence
  Synthetic oligonucleotide
tcatgttggaagtggcagcgacgtt

SEQ ID NO: 739163 - DNA, 25 bp, Artificial sequence
  Synthetic oligonucleotide
tcatgttggaagaggcagcgacgtt

SEQ ID NO: 739164 - DNA, 25 bp, Artificial sequence
  Synthetic oligonucleotide
ctctctcatgttcgaagtggcagcg

SEQ ID NO: 739165 - DNA, 25 bp, Artificial sequence
  Synthetic oligonucleotide
catgttggaagtcgcagcgacgttt

SEQ ID NO: 739166 - DNA, 25 bp, Artificial sequence
  Synthetic oligonucleotide
cctctctcatgttggaagtggcagc

SEQ ID NO: 739167 - DNA, 25 bp, Artificial sequence
  Synthetic oligonucleotide
tgttggaagtgggagcgacgtttgg

SEQ ID NO: 739168 - DNA, 25 bp, Artificial sequence
  Synthetic oligonucleotide
gttggaagtggcagcgacgtttggg

SEQ ID NO: 739169 - DNA, 25 bp, Artificial sequence
  Synthetic oligonucleotide
gttggaagtggctgcgacgtttggg

SEQ ID NO: 739170 - DNA, 25 bp, Artificial sequence
  Synthetic oligonucleotide
ttggaagtggcagcgacgtttgggg

SEQ ID NO: 739171 - DNA, 25 bp, Artificial sequence
  Synthetic oligonucleotide
ttggaagtggcaccgacgtttgggg

SEQ ID NO: 739172 - DNA, 25 bp, Artificial sequence
  Synthetic oligonucleotide
tggaagtggcagcgacgtttggggc

SEQ ID NO: 739173 - DNA, 25 bp, Artificial sequence
  Synthetic oligonucleotide
tggaagtggcagggacgtttggggc

SEQ ID NO: 739174 - DNA, 25 bp, Artificial sequence
  Synthetic oligonucleotide
ggaagtggcagcgacgtttggggct

SEQ ID NO: 739175 - DNA, 25 bp, Artificial sequence
  Synthetic oligonucleotide
ggaagtggcagccacgtttggggct

SEQ ID NO: 739176 - DNA, 25 bp, Artificial sequence
  Synthetic oligonucleotide
aagtggcagcgacgtttggggctga

SEQ ID NO: 739177 - DNA, 25 bp, Artificial sequence
  Synthetic oligonucleotide
aagtggcagcgaggtttggggctga

SEQ ID NO: 739178 - DNA, 25 bp, Artificial sequence
  Synthetic oligonucleotide
agtggcagcgacctttggggctgat

SEQ ID NO: 739179 - DNA, 25 bp, Artificial sequence
  Synthetic oligonucleotide
catgttggaagtggcagcgacgttt

SEQ ID NO: 739180 - DNA, 25 bp, Artificial sequence
  Synthetic oligonucleotide
ggaggcccctctctcatgttggaag

SEQ ID NO: 739181 - DNA, 25 bp, Artificial sequence
  Synthetic oligonucleotide
cattgctgaggacgcccctctctca

SEQ ID NO: 739182 - DNA, 25 bp, Artificial sequence
  Synthetic oligonucleotide
cattgctgaggaggcccctctctca

SEQ ID NO: 739183 - DNA, 25 bp, Artificial sequence
  Synthetic oligonucleotide
attgctgaggaggcccctctctcat

SEQ ID NO: 739184 - DNA, 25 bp, Artificial sequence
  Synthetic oligonucleotide
attgctgaggagccccctctctcat

SEQ ID NO: 739185 - DNA, 25 bp, Artificial sequence
  Synthetic oligonucleotide
ttgctgaggaggcccctctctcatg

SEQ ID NO: 739186 - DNA, 25 bp, Artificial sequence
  Synthetic oligonucleotide
ttgctgaggagggccctctctcatg

SEQ ID NO: 739187 - DNA, 25 bp, Artificial sequence
  Synthetic oligonucleotide
tgctgaggaggcgcctctctcatgt

SEQ ID NO: 739188 - DNA, 25 bp, Artificial sequence
  Synthetic oligonucleotide
tgctgaggaggcccctctctcatgt

SEQ ID NO: 739189 - DNA, 25 bp, Artificial sequence
  Synthetic oligonucleotide
gaggaggcccctgtctcatgttgga

SEQ ID NO: 739190 - DNA, 25 bp, Artificial sequence
  Synthetic oligonucleotide
gaggaggcccctctctcatgttgga

SEQ ID NO: 739191 - DNA, 25 bp, Artificial sequence
  Synthetic oligonucleotide
aggaggcccctctctcatgttggaa

SEQ ID NO: 739192 - DNA, 25 bp, Artificial sequence
  Synthetic oligonucleotide
ctctctcatgttggaagtggcagcg

SEQ ID NO: 739193 - DNA, 25 bp, Artificial sequence
  Synthetic oligonucleotide
ggaggcccctctgtcatgttggaag

SEQ ID NO: 739194 - DNA, 25 bp, Artificial sequence
  Synthetic oligonucleotide
ccctctctcatgatggaagtggcag

SEQ ID NO: 739195 - DNA, 25 bp, Artificial sequence
  Synthetic oligonucleotide
gaggcccctctcacatgttggaagt

SEQ ID NO: 739196 - DNA, 25 bp, Artificial sequence
  Synthetic oligonucleotide
gaggcccctctctcatgttggaagt

SEQ ID NO: 739197 - DNA, 25 bp, Artificial sequence
  Synthetic oligonucleotide
aggcccctctctcatgttggaagtg

SEQ ID NO: 739198 - DNA, 25 bp, Artificial sequence
  Synthetic oligonucleotide
aggcccctctctgatgttggaagtg

SEQ ID NO: 739199 - DNA, 25 bp, Artificial sequence
  Synthetic oligonucleotide
ggcccctctctcttgttggaagtgg

SEQ ID NO: 739200 - DNA, 25 bp, Artificial sequence
  Synthetic oligonucleotide
ggcccctctctcatgttggaagtgg

SEQ ID NO: 739201 - DNA, 25 bp, Artificial sequence
  Synthetic oligonucleotide
gcccctctctcatgttggaagtggc

SEQ ID NO: 739202 - DNA, 25 bp, Artificial sequence
  Synthetic oligonucleotide
gcccctctctcaagttggaagtggc

SEQ ID NO: 739203 - DNA, 25 bp, Artificial sequence
  Synthetic oligonucleotide
tggcagcgacgtttggggctgatcc

SEQ ID NO: 739204 - DNA, 25 bp, Artificial sequence
  Synthetic oligonucleotide
cccctctctcatgttggaagtggca

SEQ ID NO: 739205 - DNA, 25 bp, Artificial sequence
  Synthetic oligonucleotide
ccctctctcatgttggaagtggcag

SEQ ID NO: 739206 - DNA, 25 bp, Artificial sequence
  Synthetic oligonucleotide
cctctctcatgtaggaagtggcagc

SEQ ID NO: 739207 - DNA, 25 bp, Artificial sequence
  Synthetic oligonucleotide
aggaggcccctcactcatgttggaa

SEQ ID NO: 739208 - DNA, 25 bp, Artificial sequence
  Synthetic oligonucleotide
ggcagcgacgttaggggctgatccc

SEQ ID NO: 739209 - DNA, 25 bp, Artificial sequence
  Synthetic oligonucleotide
ggcagcgacgtttggggctgatccc

SEQ ID NO: 739210 - DNA, 25 bp, Artificial sequence
  Synthetic oligonucleotide
cccctctctcatcttggaagtggca

SEQ ID NO: 739211 - DNA, 25 bp, Artificial sequence
  Synthetic oligonucleotide
cgcagcaaactgccgtgctggcagg

SEQ ID NO: 739212 - DNA, 25 bp, Artificial sequence
  Synthetic oligonucleotide
atggcaggcgcaaactcgattttct

SEQ ID NO: 739213 - DNA, 25 bp, Artificial sequence
  Synthetic oligonucleotide
tacggttgcaaagtgctgaccacgc

SEQ ID NO: 739214 - DNA, 25 bp, Artificial sequence
  Synthetic oligonucleotide
tacggttgcaaactgctgaccacgc

SEQ ID NO: 739215 - DNA, 25 bp, Artificial sequence
  Synthetic oligonucleotide
caaactgctgacgacgccgaatccg

SEQ ID NO: 739216 - DNA, 25 bp, Artificial sequence
  Synthetic oligonucleotide
caaactgctgaccacgccgaatccg

SEQ ID NO: 739217 - DNA, 25 bp, Artificial sequence
  Synthetic oligonucleotide
gacctgcaactgttccgcaaactgg

SEQ ID NO: 739218 - DNA, 25 bp, Artificial sequence
  Synthetic oligonucleotide
gacctgcaactgatccgcaaactgg

SEQ ID NO: 739219 - DNA, 25 bp, Artificial sequence
  Synthetic oligonucleotide
gggctaaatccggagcaaactgccg

SEQ ID NO: 739220 - DNA, 25 bp, Artificial sequence
  Synthetic oligonucleotide
atattacaacgcggcagcattatga

SEQ ID NO: 739221 - DNA, 25 bp, Artificial sequence
  Synthetic oligonucleotide
cgcagcaaactggcgtgctggcagg

SEQ ID NO: 739222 - DNA, 25 bp, Artificial sequence
  Synthetic oligonucleotide
gtgctttatggctggcgcaaactcg

SEQ ID NO: 739223 - DNA, 25 bp, Artificial sequence
  Synthetic oligonucleotide
acagcaacgtctagaacaggcgctg

SEQ ID NO: 739224 - DNA, 25 bp, Artificial sequence
  Synthetic oligonucleotide
acagcaacgtcttgaacaggcgctg

SEQ ID NO: 739225 - DNA, 25 bp, Artificial sequence
  Synthetic oligonucleotide
cgtcttgaacaggcgctgatgaccc

SEQ ID NO: 739226 - DNA, 25 bp, Artificial sequence
  Synthetic oligonucleotide
acaggcgctgatgaccccggacacc

SEQ ID NO: 739227 - DNA, 25 bp, Artificial sequence
  Synthetic oligonucleotide
atattacaacgccgcagcattatga

SEQ ID NO: 739228 - DNA, 25 bp, Artificial sequence
  Synthetic oligonucleotide
gggctaaatccgcagcaaactgccg

SEQ ID NO: 739229 - DNA, 25 bp, Artificial sequence
  Synthetic oligonucleotide
cgagcagatgaaggaacagactcag

SEQ ID NO: 739230 - DNA, 25 bp, Artificial sequence
  Synthetic oligonucleotide
ggtcgcgcggatcatgatgccaacc

SEQ ID NO: 739231 - DNA, 25 bp, Artificial sequence
  Synthetic oligonucleotide
ggtcgcgcggatgatgatgccaacc

SEQ ID NO: 739232 - DNA, 25 bp, Artificial sequence
  Synthetic oligonucleotide
ggatcatgatgcgaacctcttacgt

SEQ ID NO: 739233 - DNA, 25 bp, Artificial sequence
  Synthetic oligonucleotide
ggatcatgatgccaacctcttacgt

SEQ ID NO: 739234 - DNA, 25 bp, Artificial sequence
  Synthetic oligonucleotide
tgccaacctctttcgtgcgcctttc

SEQ ID NO: 739235 - DNA, 25 bp, Artificial sequence
  Synthetic oligonucleotide
tgccaacctcttacgtgcgcctttc

SEQ ID NO: 739236 - DNA, 25 bp, Artificial sequence
  Synthetic oligonucleotide
gcgcctttctgccggacgcgagcag

SEQ ID NO: 739237 - DNA, 25 bp, Artificial sequence
  Synthetic oligonucleotide
gcgcctttctgcgggacgcgagcag

SEQ ID NO: 739238 - DNA, 25 bp, Artificial sequence
  Synthetic oligonucleotide
atggcaggcgcatactcgattttct

SEQ ID NO: 739239 - DNA, 25 bp, Artificial sequence
  Synthetic oligonucleotide
gccggacgcgaggagatgaacgaac

SEQ ID NO: 739240 - DNA, 25 bp, Artificial sequence
  Synthetic oligonucleotide
gtgctttatggcaggcgcaaactcg

SEQ ID NO: 739241 - DNA, 25 bp, Artificial sequence
  Synthetic oligonucleotide
cgagcagatgaacgaacagactcag

SEQ ID NO: 739242 - DNA, 25 bp, Artificial sequence
  Synthetic oligonucleotide
gatgaacgaacagactcaggcgatg

SEQ ID NO: 739243 - DNA, 25 bp, Artificial sequence
  Synthetic oligonucleotide
gatgaacgaacacactcaggcgatg

SEQ ID NO: 739244 - DNA, 25 bp, Artificial sequence
  Synthetic oligonucleotide
aacagactcaggcgatgtgctttat

SEQ ID NO: 739245 - DNA, 25 bp, Artificial sequence
  Synthetic oligonucleotide
aacagactcaggggatgtgctttat

SEQ ID NO: 739246 - DNA, 25 bp, Artificial sequence
  Synthetic oligonucleotide
tcaggcgatgtgctttatggcaggc

SEQ ID NO: 739247 - DNA, 25 bp, Artificial sequence
  Synthetic oligonucleotide
tcaggcgatgtggtttatggcaggc

SEQ ID NO: 739248 - DNA, 25 bp, Artificial sequence
  Synthetic oligonucleotide
acaggcgctgatcaccccggacacc

SEQ ID NO: 739249 - DNA, 25 bp, Artificial sequence
  Synthetic oligonucleotide
gccggacgcgagcagatgaacgaac

SEQ ID NO: 739250 - DNA, 25 bp, Artificial sequence
  Synthetic oligonucleotide
cgtcttgaacagccgctgatgaccc

SEQ ID NO: 739251 - DNA, 25 bp, Artificial sequence
  Synthetic oligonucleotide
acagcaacgtctagaacaggcgctg

SEQ ID NO: 739252 - DNA, 25 bp, Artificial sequence
  Synthetic oligonucleotide
tacggttgcaaactgctgaccacgc

SEQ ID NO: 739253 - DNA, 25 bp, Artificial sequence
  Synthetic oligonucleotide
aacagactcaggggatgtgctttat

SEQ ID NO: 739254 - DNA, 25 bp, Artificial sequence
  Synthetic oligonucleotide
caaactgctgaccacgccgaatccg

SEQ ID NO: 739255 - DNA, 25 bp, Artificial sequence
  Synthetic oligonucleotide
gacctgcaactgttccgcaaactgg

SEQ ID NO: 739256 - DNA, 25 bp, Artificial sequence
  Synthetic oligonucleotide
gacctgcaactgatccgcaaactgg

SEQ ID NO: 739257 - DNA, 25 bp, Artificial sequence
  Synthetic oligonucleotide
gggctaaatccggagcaaactgccg

SEQ ID NO: 739258 - DNA, 25 bp, Artificial sequence
  Synthetic oligonucleotide
gggctaaatccgcagcaaactgccg

SEQ ID NO: 739259 - DNA, 25 bp, Artificial sequence
  Synthetic oligonucleotide
atggcaggcgcaaactcgattttct

SEQ ID NO: 739260 - DNA, 25 bp, Artificial sequence
  Synthetic oligonucleotide
cgcagcaaactgccgtgctggcagg

SEQ ID NO: 739261 - DNA, 25 bp, Artificial sequence
  Synthetic oligonucleotide
tacggttgcaaagtgctgaccacgc

SEQ ID NO: 739262 - DNA, 25 bp, Artificial sequence
  Synthetic oligonucleotide
acagcaacgtcttgaacaggcgctg

SEQ ID NO: 739263 - DNA, 25 bp, Artificial sequence
  Synthetic oligonucleotide
cgtcttgaacagccgctgatgaccc

SEQ ID NO: 739264 - DNA, 25 bp, Artificial sequence
  Synthetic oligonucleotide
cgtcttgaacaggcgctgatgaccc

SEQ ID NO: 739265 - DNA, 25 bp, Artificial sequence
  Synthetic oligonucleotide
acaggcgctgatcaccccggacacc

SEQ ID NO: 739266 - DNA, 25 bp, Artificial sequence
  Synthetic oligonucleotide
acaggcgctgatgaccccggacacc

SEQ ID NO: 739267 - DNA, 25 bp, Artificial sequence
  Synthetic oligonucleotide
atattacaacgccgcagcattatga

SEQ ID NO: 739268 - DNA, 25 bp, Artificial sequence
  Synthetic oligonucleotide
atattacaacgcggcagcattatga

SEQ ID NO: 739269 - DNA, 25 bp, Artificial sequence
  Synthetic oligonucleotide
cgcagcaaactggcgtgctggcagg

SEQ ID NO: 739270 - DNA, 25 bp, Artificial sequence
  Synthetic oligonucleotide
gccggacgcgaggagatgaacgaac

SEQ ID NO: 739271 - DNA, 25 bp, Artificial sequence
  Synthetic oligonucleotide
ggtcgcgcggatgatgatgccaacc

SEQ ID NO: 739272 - DNA, 25 bp, Artificial sequence
  Synthetic oligonucleotide
ggtcgcgcggatcatgatgccaacc

SEQ ID NO: 739273 - DNA, 25 bp, Artificial sequence
  Synthetic oligonucleotide
ggatcatgatgccaacctcttacgt

SEQ ID NO: 739274 - DNA, 25 bp, Artificial sequence
  Synthetic oligonucleotide
ggatcatgatgcgaacctcttacgt

SEQ ID NO: 739275 - DNA, 25 bp, Artificial sequence
  Synthetic oligonucleotide
tgccaacctcttacgtgcgcctttc

SEQ ID NO: 739276 - DNA, 25 bp, Artificial sequence
  Synthetic oligonucleotide
tgccaacctctttcgtgcgcctttc

SEQ ID NO: 739277 - DNA, 25 bp, Artificial sequence
  Synthetic oligonucleotide
caaactgctgacgacgccgaatccg

SEQ ID NO: 739278 - DNA, 25 bp, Artificial sequence
  Synthetic oligonucleotide
gcgcctttctgccggacgcgagcag

SEQ ID NO: 739279 - DNA, 25 bp, Artificial sequence
  Synthetic oligonucleotide
atggcaggcgcatactcgattttct

SEQ ID NO: 739280 - DNA, 25 bp, Artificial sequence
  Synthetic oligonucleotide
gccggacgcgagcagatgaacgaac

SEQ ID NO: 739281 - DNA, 25 bp, Artificial sequence
  Synthetic oligonucleotide
tcaggcgatgtgctttatggcaggc

SEQ ID NO: 739282 - DNA, 25 bp, Artificial sequence
  Synthetic oligonucleotide
gtgctttatggcaggcgcaaactcg

SEQ ID NO: 739283 - DNA, 25 bp, Artificial sequence
  Synthetic oligonucleotide
gcgcctttctgcgggacgcgagcag

SEQ ID NO: 739284 - DNA, 25 bp, Artificial sequence
  Synthetic oligonucleotide
gtgctttatggctggcgcaaactcg

SEQ ID NO: 739285 - DNA, 25 bp, Artificial sequence
  Synthetic oligonucleotide
cgagcagatgaacgaacagactcag

SEQ ID NO: 739286 - DNA, 25 bp, Artificial sequence
  Synthetic oligonucleotide
aacagactcaggcgatgtgctttat

SEQ ID NO: 739287 - DNA, 25 bp, Artificial sequence
  Synthetic oligonucleotide
tcaggcgatgtggtttatggcaggc

SEQ ID NO: 739288 - DNA, 25 bp, Artificial sequence
  Synthetic oligonucleotide
gatgaacgaacagactcaggcgatg

SEQ ID NO: 739289 - DNA, 25 bp, Artificial sequence
  Synthetic oligonucleotide
gatgaacgaacacactcaggcgatg

SEQ ID NO: 739290 - DNA, 25 bp, Artificial sequence
  Synthetic oligonucleotide
cgagcagatgaaggaacagactcag

SEQ ID NO: 739291 - DNA, 25 bp, Artificial sequence
  Synthetic oligonucleotide
gttgctggatctcctgtttgaagcg

SEQ ID NO: 739292 - DNA, 25 bp, Artificial sequence
  Synthetic oligonucleotide
caaagcgaaagcggcaggatcgacg

SEQ ID NO: 739293 - DNA, 25 bp, Artificial sequence
  Synthetic oligonucleotide
gacattgtcgcaagtcacagaatta

SEQ ID NO: 739294 - DNA, 25 bp, Artificial sequence
  Synthetic oligonucleotide
gacattgtcgcatgtcacagaatta

SEQ ID NO: 739295 - DNA, 25 bp, Artificial sequence
  Synthetic oligonucleotide
attgtcgcaagtgacagaattattt

SEQ ID NO: 739296 - DNA, 25 bp, Artificial sequence
  Synthetic oligonucleotide
attgtcgcaagtcacagaattattt

SEQ ID NO: 739297 - DNA, 25 bp, Artificial sequence
  Synthetic oligonucleotide
gcatttcgatccacgtcaggtgcag

SEQ ID NO: 739298 - DNA, 25 bp, Artificial sequence
  Synthetic oligonucleotide
caaatactgcccgcaaacgtcgcgc

SEQ ID NO: 739299 - DNA, 25 bp, Artificial sequence
  Synthetic oligonucleotide
gcatcgccagcaattcgatcctcgt

SEQ ID NO: 739300 - DNA, 25 bp, Artificial sequence
  Synthetic oligonucleotide
gctgtcgattaagaccggagcttgt

SEQ ID NO: 739301 - DNA, 25 bp, Artificial sequence
  Synthetic oligonucleotide
gctgtcgattaacaccggagcttgt

SEQ ID NO: 739302 - DNA, 25 bp, Artificial sequence
  Synthetic oligonucleotide
agcttgtccggatgattgcaaatac

SEQ ID NO: 739303 - DNA, 25 bp, Artificial sequence
  Synthetic oligonucleotide
agcttgtccggaagattgcaaatac

SEQ ID NO: 739304 - DNA, 25 bp, Artificial sequence
  Synthetic oligonucleotide
cagcacgttgctgtcgattaagacc

SEQ ID NO: 739305 - DNA, 25 bp, Artificial sequence
  Synthetic oligonucleotide
agattgcaaatagtgcccgcaaacg

SEQ ID NO: 739306 - DNA, 25 bp, Artificial sequence
  Synthetic oligonucleotide
gcaggtcagcacgttgctgtcgatt

SEQ ID NO: 739307 - DNA, 25 bp, Artificial sequence
  Synthetic oligonucleotide
caaatactgcccccaaacgtcgcgc

SEQ ID NO: 739308 - DNA, 25 bp, Artificial sequence
  Synthetic oligonucleotide
tgaacaggtgctcgagtcggcgcgc

SEQ ID NO: 739309 - DNA, 25 bp, Artificial sequence
  Synthetic oligonucleotide
tgaacaggtgctggagtcggcgcgc

SEQ ID NO: 739310 - DNA, 25 bp, Artificial sequence
  Synthetic oligonucleotide
ggagtcggcgcgcaaagcgaaagcg

SEQ ID NO: 739311 - DNA, 25 bp, Artificial sequence
  Synthetic oligonucleotide
caaagcgaaagccgcaggatcgacg

SEQ ID NO: 739312 - DNA, 25 bp, Artificial sequence
  Synthetic oligonucleotide
ggcaggatcgacgcgcttctgtatg

SEQ ID NO: 739313 - DNA, 25 bp, Artificial sequence
  Synthetic oligonucleotide
agattgcaaatactgcccgcaaacg

SEQ ID NO: 739314 - DNA, 25 bp, Artificial sequence
  Synthetic oligonucleotide
ggcaggatcgacccgcttctgtatg

SEQ ID NO: 739315 - DNA, 25 bp, Artificial sequence
  Synthetic oligonucleotide
ggatctgctgttagaagcgcagcag

SEQ ID NO: 739316 - DNA, 25 bp, Artificial sequence
  Synthetic oligonucleotide
ggatctgctgtttgaagcgcagcag

SEQ ID NO: 739317 - DNA, 25 bp, Artificial sequence
  Synthetic oligonucleotide
gcgcagcaggtgcatcgccagcatt

SEQ ID NO: 739318 - DNA, 25 bp, Artificial sequence
  Synthetic oligonucleotide
gcgcagcaggtggatcgccagcatt

SEQ ID NO: 739319 - DNA, 25 bp, Artificial sequence
  Synthetic oligonucleotide
gcaggtgcatcgccagcatttcgat

SEQ ID NO: 739320 - DNA, 25 bp, Artificial sequence
  Synthetic oligonucleotide
cagcacgttgctctcgattaagacc

SEQ ID NO: 739321 - DNA, 25 bp, Artificial sequence
  Synthetic oligonucleotide
gcatcgccagcatttcgatcctcgt

SEQ ID NO: 739322 - DNA, 25 bp, Artificial sequence
  Synthetic oligonucleotide
gttgctggatctgctgtttgaagcg

SEQ ID NO: 739323 - DNA, 25 bp, Artificial sequence
  Synthetic oligonucleotide
gcatttcgatcctcgtcaggtgcag

SEQ ID NO: 739324 - DNA, 25 bp, Artificial sequence
  Synthetic oligonucleotide
cgatcctcgtcacgtgcaggtcagc

SEQ ID NO: 739325 - DNA, 25 bp, Artificial sequence
  Synthetic oligonucleotide
cgatcctcgtcaggtgcaggtcagc

SEQ ID NO: 739326 - DNA, 25 bp, Artificial sequence
  Synthetic oligonucleotide
tcgtcaggtgcacgtcagcacgttg

SEQ ID NO: 739327 - DNA, 25 bp, Artificial sequence
  Synthetic oligonucleotide
tcgtcaggtgcaggtcagcacgttg

SEQ ID NO: 739328 - DNA, 25 bp, Artificial sequence
  Synthetic oligonucleotide
gcaggtcagcaccttgctgtcgatt

SEQ ID NO: 739329 - DNA, 25 bp, Artificial sequence
  Synthetic oligonucleotide
gcaggtgcatcggcagcatttcgat

SEQ ID NO: 739330 - DNA, 25 bp, Artificial sequence
  Synthetic oligonucleotide
ggagtcggcgcggaaagcgaaagcg

SEQ ID NO: 739331 - DNA, 25 bp, Artificial sequence
  Synthetic oligonucleotide
gacattgtcgcatgtcacagaatta

SEQ ID NO: 739332 - DNA, 25 bp, Artificial sequence
  Synthetic oligonucleotide
gcatcgccagcatttcgatcctcgt

SEQ ID NO: 739333 - DNA, 25 bp, Artificial sequence
  Synthetic oligonucleotide
gcaggtgcatcgccagcatttcgat

SEQ ID NO: 739334 - DNA, 25 bp, Artificial sequence
  Synthetic oligonucleotide
gcgcagcaggtgcatcgccagcatt

SEQ ID NO: 739335 - DNA, 25 bp, Artificial sequence
  Synthetic oligonucleotide
gcgcagcaggtggatcgccagcatt

SEQ ID NO: 739336 - DNA, 25 bp, Artificial sequence
  Synthetic oligonucleotide
ggatctgctgtttgaagcgcagcag

SEQ ID NO: 739337 - DNA, 25 bp, Artificial sequence
  Synthetic oligonucleotide
ggatctgctgttagaagcgcagcag

SEQ ID NO: 739338 - DNA, 25 bp, Artificial sequence
  Synthetic oligonucleotide
gttgctggatctcctgtttgaagcg

SEQ ID NO: 739339 - DNA, 25 bp, Artificial sequence
  Synthetic oligonucleotide
gttgctggatctgctgtttgaagcg

SEQ ID NO: 739340 - DNA, 25 bp, Artificial sequence
  Synthetic oligonucleotide
attgtcgcaagtcacagaattattt

SEQ ID NO: 739341 - DNA, 25 bp, Artificial sequence
  Synthetic oligonucleotide
gcatttcgatccacgtcaggtgcag

SEQ ID NO: 739342 - DNA, 25 bp, Artificial sequence
  Synthetic oligonucleotide
gacattgtcgcaagtcacagaatta

SEQ ID NO: 739343 - DNA, 25 bp, Artificial sequence
  Synthetic oligonucleotide
gcatcgccagcaattcgatcctcgt

SEQ ID NO: 739344 - DNA, 25 bp, Artificial sequence
  Synthetic oligonucleotide
caaatactgcccccaaacgtcgcgc

SEQ ID NO: 739345 - DNA, 25 bp, Artificial sequence
  Synthetic oligonucleotide
caaatactgcccgcaaacgtcgcgc

SEQ ID NO: 739346 - DNA, 25 bp, Artificial sequence
  Synthetic oligonucleotide
tgaacaggtgctggagtcggcgcgc

SEQ ID NO: 739347 - DNA, 25 bp, Artificial sequence
  Synthetic oligonucleotide
tgaacaggtgctcgagtcggcgcgc

SEQ ID NO: 739348 - DNA, 25 bp, Artificial sequence
  Synthetic oligonucleotide
ggagtcggcgcggaaagcgaaagcg

SEQ ID NO: 739349 - DNA, 25 bp, Artificial sequence
  Synthetic oligonucleotide
ggagtcggcgcgcaaagcgaaagcg

SEQ ID NO: 739350 - DNA, 25 bp, Artificial sequence
  Synthetic oligonucleotide
caaagcgaaagcggcaggatcgacg

SEQ ID NO: 739351 - DNA, 25 bp, Artificial sequence
  Synthetic oligonucleotide
caaagcgaaagccgcaggatcgacg

SEQ ID NO: 739352 - DNA, 25 bp, Artificial sequence
  Synthetic oligonucleotide
ggcaggatcgacccgcttctgtatg

SEQ ID NO: 739353 - DNA, 25 bp, Artificial sequence
  Synthetic oligonucleotide
attgtcgcaagtgacagaattattt

SEQ ID NO: 739354 - DNA, 25 bp, Artificial sequence
  Synthetic oligonucleotide
agcttgtccggatgattgcaaatac

SEQ ID NO: 739355 - DNA, 25 bp, Artificial sequence
  Synthetic oligonucleotide
agattgcaaatactgcccgcaaacg

SEQ ID NO: 739356 - DNA, 25 bp, Artificial sequence
  Synthetic oligonucleotide
cgatcctcgtcacgtgcaggtcagc

SEQ ID NO: 739357 - DNA, 25 bp, Artificial sequence
  Synthetic oligonucleotide
cgatcctcgtcaggtgcaggtcagc

SEQ ID NO: 739358 - DNA, 25 bp, Artificial sequence
  Synthetic oligonucleotide
tcgtcaggtgcacgtcagcacgttg

SEQ ID NO: 739359 - DNA, 25 bp, Artificial sequence
  Synthetic oligonucleotide
gcaggtcagcaccttgctgtcgatt

SEQ ID NO: 739360 - DNA, 25 bp, Artificial sequence
  Synthetic oligonucleotide
cagcacgttgctgtcgattaagacc

SEQ ID NO: 739361 - DNA, 25 bp, Artificial sequence
  Synthetic oligonucleotide
cagcacgttgctctcgattaagacc

SEQ ID NO: 739362 - DNA, 25 bp, Artificial sequence
  Synthetic oligonucleotide
gcatttcgatcctcgtcaggtgcag

SEQ ID NO: 739363 - DNA, 25 bp, Artificial sequence
  Synthetic oligonucleotide
gctgtcgattaacaccggagcttgt

SEQ ID NO: 739364 - DNA, 25 bp, Artificial sequence
  Synthetic oligonucleotide
gcaggtcagcacgttgctgtcgatt

SEQ ID NO: 739365 - DNA, 25 bp, Artificial sequence
  Synthetic oligonucleotide
agcttgtccggaagattgcaaatac

SEQ ID NO: 739366 - DNA, 25 bp, Artificial sequence
  Synthetic oligonucleotide
agattgcaaatagtgcccgcaaacg

SEQ ID NO: 739367 - DNA, 25 bp, Artificial sequence
  Synthetic oligonucleotide
ggcaggatcgacgcgcttctgtatg

SEQ ID NO: 739368 - DNA, 25 bp, Artificial sequence
  Synthetic oligonucleotide
tcgtcaggtgcaggtcagcacgttg

SEQ ID NO: 739369 - DNA, 25 bp, Artificial sequence
  Synthetic oligonucleotide
gcaggtgcatcggcagcatttcgat

SEQ ID NO: 739370 - DNA, 25 bp, Artificial sequence
  Synthetic oligonucleotide
gctgtcgattaagaccggagcttgt

SEQ ID NO: 739371 - DNA, 25 bp, Artificial sequence
  Synthetic oligonucleotide
gccgggatcaaactctgttctggcg

SEQ ID NO: 739372 - DNA, 25 bp, Artificial sequence
  Synthetic oligonucleotide
aagtctgttctgccggcattgtggg

SEQ ID NO: 739373 - DNA, 25 bp, Artificial sequence
  Synthetic oligonucleotide
gccgggatcaaagtctgttctggcg

SEQ ID NO: 739374 - DNA, 25 bp, Artificial sequence
  Synthetic oligonucleotide
agtgcgcgatgcggggatcaaagtc

SEQ ID NO: 739375 - DNA, 25 bp, Artificial sequence
  Synthetic oligonucleotide
aagtctgttctggcggcattgtggg

SEQ ID NO: 739376 - DNA, 25 bp, Artificial sequence
  Synthetic oligonucleotide
ggaaaaagtgcgcgatgccgggatc

SEQ ID NO: 739377 - DNA, 25 bp, Artificial sequence
  Synthetic oligonucleotide
ggaaaaagtgcgggatgccgggatc

SEQ ID NO: 739378 - DNA, 25 bp, Artificial sequence
  Synthetic oligonucleotide
atacgctggaaatagtgcgcgatgc

SEQ ID NO: 739379 - DNA, 25 bp, Artificial sequence
  Synthetic oligonucleotide
atacgctggaaaaagtgcgcgatgc

SEQ ID NO: 739380 - DNA, 25 bp, Artificial sequence
  Synthetic oligonucleotide
acgcacttatcacgaacgcctcgat

SEQ ID NO: 739381 - DNA, 25 bp, Artificial sequence
  Synthetic oligonucleotide
agtgcgcgatgccgggatcaaagtc

SEQ ID NO: 739382 - DNA, 25 bp, Artificial sequence
  Synthetic oligonucleotide
acgccgcttgccgataacgatgatg

SEQ ID NO: 739383 - DNA, 25 bp, Artificial sequence
  Synthetic oligonucleotide
tggtgaaggtgataggcacgccgct

SEQ ID NO: 739384 - DNA, 25 bp, Artificial sequence
  Synthetic oligonucleotide
caatcaacatgcaggtgaaggtgaa

SEQ ID NO: 739385 - DNA, 25 bp, Artificial sequence
  Synthetic oligonucleotide
caatcaacatgctggtgaaggtgaa

SEQ ID NO: 739386 - DNA, 25 bp, Artificial sequence
  Synthetic oligonucleotide
aagcgtgccaatgaacatgctggtg

SEQ ID NO: 739387 - DNA, 25 bp, Artificial sequence
  Synthetic oligonucleotide
aagcgtgccaatcaacatgctggtg

SEQ ID NO: 739388 - DNA, 25 bp, Artificial sequence
  Synthetic oligonucleotide
cgccggaaagcgagccaatcaacat

SEQ ID NO: 739389 - DNA, 25 bp, Artificial sequence
  Synthetic oligonucleotide
cgccggaaagcgtgccaatcaacat

SEQ ID NO: 739390 - DNA, 25 bp, Artificial sequence
  Synthetic oligonucleotide
attgctgcaactcgcaaacctgccg

SEQ ID NO: 739391 - DNA, 25 bp, Artificial sequence
  Synthetic oligonucleotide
gccggattattgctgcaactggcaa

SEQ ID NO: 739392 - DNA, 25 bp, Artificial sequence
  Synthetic oligonucleotide
acgccgcttgcccataacgatgatg

SEQ ID NO: 739393 - DNA, 25 bp, Artificial sequence
  Synthetic oligonucleotide
aagatcgcgccgcattattgctgca

SEQ ID NO: 739394 - DNA, 25 bp, Artificial sequence
  Synthetic oligonucleotide
gcaatatcatcagcacacgcactta

SEQ ID NO: 739395 - DNA, 25 bp, Artificial sequence
  Synthetic oligonucleotide
ttgccgataacgttgatgtcgatgc

SEQ ID NO: 739396 - DNA, 25 bp, Artificial sequence
  Synthetic oligonucleotide
acgcacttatcaggaacgcctcgat

SEQ ID NO: 739397 - DNA, 25 bp, Artificial sequence
  Synthetic oligonucleotide
ttgccgataacgatgatgtcgatgc

SEQ ID NO: 739398 - DNA, 25 bp, Artificial sequence
  Synthetic oligonucleotide
acgatgatgtcgatgcctttgattt

SEQ ID NO: 739399 - DNA, 25 bp, Artificial sequence
  Synthetic oligonucleotide
acgatgatgtcgttgcctttgattt

SEQ ID NO: 739400 - DNA, 25 bp, Artificial sequence
  Synthetic oligonucleotide
tggtgaaggtgaaaggcacgccgct

SEQ ID NO: 739401 - DNA, 25 bp, Artificial sequence
  Synthetic oligonucleotide
gccggattattggtgcaactggcaa

SEQ ID NO: 739402 - DNA, 25 bp, Artificial sequence
  Synthetic oligonucleotide
aagatcgcgccggattattgctgca

SEQ ID NO: 739403 - DNA, 25 bp, Artificial sequence
  Synthetic oligonucleotide
attgctgcaactggcaaacctgccg

SEQ ID NO: 739404 - DNA, 25 bp, Artificial sequence
  Synthetic oligonucleotide
atcaccacacgcacttatcaggaac

SEQ ID NO: 739405 - DNA, 25 bp, Artificial sequence
  Synthetic oligonucleotide
gcaatatcatcaccacacgcactta

SEQ ID NO: 739406 - DNA, 25 bp, Artificial sequence
  Synthetic oligonucleotide
gttttacggcaatatcatcaccaca

SEQ ID NO: 739407 - DNA, 25 bp, Artificial sequence
  Synthetic oligonucleotide
gttttacggcaaaatcatcaccaca

SEQ ID NO: 739408 - DNA, 25 bp, Artificial sequence
  Synthetic oligonucleotide
gccggagttttacggcaatatcatc

SEQ ID NO: 739409 - DNA, 25 bp, Artificial sequence
  Synthetic oligonucleotide
atcaccacacgctcttatcaggaac

SEQ ID NO: 739410 - DNA, 25 bp, Artificial sequence
  Synthetic oligonucleotide
gccggagttttagggcaatatcatc

SEQ ID NO: 739411 - DNA, 25 bp, Artificial sequence
  Synthetic oligonucleotide
aagtctgttctggcggcattgtggg

SEQ ID NO: 739412 - DNA, 25 bp, Artificial sequence
  Synthetic oligonucleotide
gccgggatcaaactctgttctggcg

SEQ ID NO: 739413 - DNA, 25 bp, Artificial sequence
  Synthetic oligonucleotide
agtgcgcgatgcggggatcaaagtc

SEQ ID NO: 739414 - DNA, 25 bp, Artificial sequence
  Synthetic oligonucleotide
aagtctgttctgccggcattgtggg

SEQ ID NO: 739415 - DNA, 25 bp, Artificial sequence
  Synthetic oligonucleotide
ggaaaaagtgcgggatgccgggatc

SEQ ID NO: 739416 - DNA, 25 bp, Artificial sequence
  Synthetic oligonucleotide
gccggattattgctgcaactggcaa

SEQ ID NO: 739417 - DNA, 25 bp, Artificial sequence
  Synthetic oligonucleotide
atacgctggaaaaagtgcgcgatgc

SEQ ID NO: 739418 - DNA, 25 bp, Artificial sequence
  Synthetic oligonucleotide
atacgctggaaatagtgcgcgatgc

SEQ ID NO: 739419 - DNA, 25 bp, Artificial sequence
  Synthetic oligonucleotide
ggaaaaagtgcgcgatgccgggatc

SEQ ID NO: 739420 - DNA, 25 bp, Artificial sequence
  Synthetic oligonucleotide
aagatcgcgccgcattattgctgca

SEQ ID NO: 739421 - DNA, 25 bp, Artificial sequence
  Synthetic oligonucleotide
acgcacttatcacgaacgcctcgat

SEQ ID NO: 739422 - DNA, 25 bp, Artificial sequence
  Synthetic oligonucleotide
gccggattattggtgcaactggcaa

SEQ ID NO: 739423 - DNA, 25 bp, Artificial sequence
  Synthetic oligonucleotide
agtgcgcgatgccgggatcaaagtc

SEQ ID NO: 739424 - DNA, 25 bp, Artificial sequence
  Synthetic oligonucleotide
attgctgcaactggcaaacctgccg

SEQ ID NO: 739425 - DNA, 25 bp, Artificial sequence
  Synthetic oligonucleotide
attgctgcaactcgcaaacctgccg

SEQ ID NO: 739426 - DNA, 25 bp, Artificial sequence
  Synthetic oligonucleotide
cgccggaaagcgagccaatcaacat

SEQ ID NO: 739427 - DNA, 25 bp, Artificial sequence
  Synthetic oligonucleotide
cgccggaaagcgtgccaatcaacat

SEQ ID NO: 739428 - DNA, 25 bp, Artificial sequence
  Synthetic oligonucleotide
aagcgtgccaatgaacatgctggtg

SEQ ID NO: 739429 - DNA, 25 bp, Artificial sequence
  Synthetic oligonucleotide
aagcgtgccaatcaacatgctggtg

SEQ ID NO: 739430 - DNA, 25 bp, Artificial sequence
  Synthetic oligonucleotide
caatcaacatgctggtgaaggtgaa

SEQ ID NO: 739431 - DNA, 25 bp, Artificial sequence
  Synthetic oligonucleotide
aagatcgcgccggattattgctgca

SEQ ID NO: 739432 - DNA, 25 bp, Artificial sequence
  Synthetic oligonucleotide
ttgccgataacgttgatgtcgatgc

SEQ ID NO: 739433 - DNA, 25 bp, Artificial sequence
  Synthetic oligonucleotide
gccgggatcaaagtctgttctggcg

SEQ ID NO: 739434 - DNA, 25 bp, Artificial sequence
  Synthetic oligonucleotide
acgcacttatcaggaacgcctcgat

SEQ ID NO: 739435 - DNA, 25 bp, Artificial sequence
  Synthetic oligonucleotide
acgatgatgtcgttgcctttgattt

SEQ ID NO: 739436 - DNA, 25 bp, Artificial sequence
  Synthetic oligonucleotide
ttgccgataacgatgatgtcgatgc

SEQ ID NO: 739437 - DNA, 25 bp, Artificial sequence
  Synthetic oligonucleotide
caatcaacatgcaggtgaaggtgaa

SEQ ID NO: 739438 - DNA, 25 bp, Artificial sequence
  Synthetic oligonucleotide
acgccgcttgccgataacgatgatg

SEQ ID NO: 739439 - DNA, 25 bp, Artificial sequence
  Synthetic oligonucleotide
acgccgcttgcccataacgatgatg

SEQ ID NO: 739440 - DNA, 25 bp, Artificial sequence
  Synthetic oligonucleotide
tggtgaaggtgaaaggcacgccgct

SEQ ID NO: 739441 - DNA, 25 bp, Artificial sequence
  Synthetic oligonucleotide
atcaccacacgctcttatcaggaac

SEQ ID NO: 739442 - DNA, 25 bp, Artificial sequence
  Synthetic oligonucleotide
gccggagttttacggcaatatcatc

SEQ ID NO: 739443 - DNA, 25 bp, Artificial sequence
  Synthetic oligonucleotide
gccggagttttagggcaatatcatc

SEQ ID NO: 739444 - DNA, 25 bp, Artificial sequence
  Synthetic oligonucleotide
gttttacggcaaaatcatcaccaca

SEQ ID NO: 739445 - DNA, 25 bp, Artificial sequence
  Synthetic oligonucleotide
gttttacggcaatatcatcaccaca

SEQ ID NO: 739446 - DNA, 25 bp, Artificial sequence
  Synthetic oligonucleotide
gcaatatcatcagcacacgcactta

SEQ ID NO: 739447 - DNA, 25 bp, Artificial sequence
  Synthetic oligonucleotide
gcaatatcatcaccacacgcactta

SEQ ID NO: 739448 - DNA, 25 bp, Artificial sequence
  Synthetic oligonucleotide
tggtgaaggtgataggcacgccgct

SEQ ID NO: 739449 - DNA, 25 bp, Artificial sequence
  Synthetic oligonucleotide
acgatgatgtcgatgcctttgattt

SEQ ID NO: 739450 - DNA, 25 bp, Artificial sequence
  Synthetic oligonucleotide
atcaccacacgcacttatcaggaac

SEQ ID NO: 739451 - DNA, 25 bp, Artificial sequence
  Synthetic oligonucleotide
ggcatcggtgcctcgcatcttcatg

SEQ ID NO: 739452 - DNA, 25 bp, Artificial sequence
  Synthetic oligonucleotide
ctgaaaggcatcggtgccacgcatc

SEQ ID NO: 739453 - DNA, 25 bp, Artificial sequence
  Synthetic oligonucleotide
ctgaaaggcatccgtgccacgcatc

SEQ ID NO: 739454 - DNA, 25 bp, Artificial sequence
  Synthetic oligonucleotide
catgcgttcgctgaaaggcatcggt

SEQ ID NO: 739455 - DNA, 25 bp, Artificial sequence
  Synthetic oligonucleotide
catgcgttcgctcaaaggcatcggt

SEQ ID NO: 739456 - DNA, 25 bp, Artificial sequence
  Synthetic oligonucleotide
ctcagtgccatgcgttcgctgaaag

SEQ ID NO: 739457 - DNA, 25 bp, Artificial sequence
  Synthetic oligonucleotide
atgatgcgctcagtgccatgcgttc

SEQ ID NO: 739458 - DNA, 25 bp, Artificial sequence
  Synthetic oligonucleotide
atgatgcgctcactgccatgcgttc

SEQ ID NO: 739459 - DNA, 25 bp, Artificial sequence
  Synthetic oligonucleotide
ggcatcggtgccacgcatcttcatg

SEQ ID NO: 739460 - DNA, 25 bp, Artificial sequence
  Synthetic oligonucleotide
ctcagtgccatgggttcgctgaaag

SEQ ID NO: 739461 - DNA, 25 bp, Artificial sequence
  Synthetic oligonucleotide
tgccacgcatctacatgaagggcgc

SEQ ID NO: 739462 - DNA, 25 bp, Artificial sequence
  Synthetic oligonucleotide
tgccacgcatcttcatgaagggcgc

SEQ ID NO: 739463 - DNA, 25 bp, Artificial sequence
  Synthetic oligonucleotide
atcttcatgaagcgcgcgacccgcg

SEQ ID NO: 739464 - DNA, 25 bp, Artificial sequence
  Synthetic oligonucleotide
atcttcatgaagggcgcgacccgcg

SEQ ID NO: 739465 - DNA, 25 bp, Artificial sequence
  Synthetic oligonucleotide
attaacgcgttcccagttgcagcga

SEQ ID NO: 739466 - DNA, 25 bp, Artificial sequence
  Synthetic oligonucleotide
attaacgcgttcgcagttgcagcga

SEQ ID NO: 739467 - DNA, 25 bp, Artificial sequence
  Synthetic oligonucleotide
gcgttcgcagttccagcgattgcaa

SEQ ID NO: 739468 - DNA, 25 bp, Artificial sequence
  Synthetic oligonucleotide
agttgcagcgatagcaactggcctg

SEQ ID NO: 739469 - DNA, 25 bp, Artificial sequence
  Synthetic oligonucleotide
agttgcagcgattgcaactggcctg

SEQ ID NO: 739470 - DNA, 25 bp, Artificial sequence
  Synthetic oligonucleotide
gcgttcgcagttgcagcgattgcaa

SEQ ID NO: 739471 - DNA, 25 bp, Artificial sequence
  Synthetic oligonucleotide
atcacgctgtggtttgatgatgcgc

SEQ ID NO: 739472 - DNA, 25 bp, Artificial sequence
  Synthetic oligonucleotide
tacccgaacgtcttcaggcgtggca

SEQ ID NO: 739473 - DNA, 25 bp, Artificial sequence
  Synthetic oligonucleotide
ggtttgatgatgcgctcagtgccat

SEQ ID NO: 739474 - DNA, 25 bp, Artificial sequence
  Synthetic oligonucleotide
tacccgaacgtcatcaggcgtggca

SEQ ID NO: 739475 - DNA, 25 bp, Artificial sequence
  Synthetic oligonucleotide
ggtggacgagcgaccgcatgctaat

SEQ ID NO: 739476 - DNA, 25 bp, Artificial sequence
  Synthetic oligonucleotide
ggtggacgagcgtccgcatgctaat

SEQ ID NO: 739477 - DNA, 25 bp, Artificial sequence
  Synthetic oligonucleotide
cgtccgcatgcttatcgctttttac

SEQ ID NO: 739478 - DNA, 25 bp, Artificial sequence
  Synthetic oligonucleotide
cgtccgcatgctaatcgctttttac

SEQ ID NO: 739479 - DNA, 25 bp, Artificial sequence
  Synthetic oligonucleotide
tttaccgccagatgaaatcgaacag

SEQ ID NO: 739480 - DNA, 25 bp, Artificial sequence
  Synthetic oligonucleotide
tttaccgccagaagaaatcgaacag

SEQ ID NO: 739481 - DNA, 25 bp, Artificial sequence
  Synthetic oligonucleotide
gatgaaatcgaagagtcgctgaacg

SEQ ID NO: 739482 - DNA, 25 bp, Artificial sequence
  Synthetic oligonucleotide
ggtttgatgatgggctcagtgccat

SEQ ID NO: 739483 - DNA, 25 bp, Artificial sequence
  Synthetic oligonucleotide
aacagtcgctgaacggcgtgcatta

SEQ ID NO: 739484 - DNA, 25 bp, Artificial sequence
  Synthetic oligonucleotide
aacagtcgctgatcggcgtgcatta

SEQ ID NO: 739485 - DNA, 25 bp, Artificial sequence
  Synthetic oligonucleotide
acatcatattcagcccatcacgctg

SEQ ID NO: 739486 - DNA, 25 bp, Artificial sequence
  Synthetic oligonucleotide
acatcatattcaccccatcacgctg

SEQ ID NO: 739487 - DNA, 25 bp, Artificial sequence
  Synthetic oligonucleotide
ttcagcccatcaggctgtggtttga

SEQ ID NO: 739488 - DNA, 25 bp, Artificial sequence
  Synthetic oligonucleotide
ttcagcccatcacgctgtggtttga

SEQ ID NO: 739489 - DNA, 25 bp, Artificial sequence
  Synthetic oligonucleotide
atcacgctgtggattgatgatgcgc

SEQ ID NO: 739490 - DNA, 25 bp, Artificial sequence
  Synthetic oligonucleotide
gatgaaatcgaacagtcgctgaacg

SEQ ID NO: 739491 - DNA, 25 bp, Artificial sequence
  Synthetic oligonucleotide
aacagtcgctgaacggcgtgcatta

SEQ ID NO: 739492 - DNA, 25 bp, Artificial sequence
  Synthetic oligonucleotide
aacagtcgctgatcggcgtgcatta

SEQ ID NO: 739493 - DNA, 25 bp, Artificial sequence
  Synthetic oligonucleotide
acatcatattcagcccatcacgctg

SEQ ID NO: 739494 - DNA, 25 bp, Artificial sequence
  Synthetic oligonucleotide
acatcatattcaccccatcacgctg

SEQ ID NO: 739495 - DNA, 25 bp, Artificial sequence
  Synthetic oligonucleotide
ttcagcccatcacgctgtggtttga

SEQ ID NO: 739496 - DNA, 25 bp, Artificial sequence
  Synthetic oligonucleotide
ttcagcccatcaggctgtggtttga

SEQ ID NO: 739497 - DNA, 25 bp, Artificial sequence
  Synthetic oligonucleotide
gatgaaatcgaacagtcgctgaacg

SEQ ID NO: 739498 - DNA, 25 bp, Artificial sequence
  Synthetic oligonucleotide
atcacgctgtggtttgatgatgcgc

SEQ ID NO: 739499 - DNA, 25 bp, Artificial sequence
  Synthetic oligonucleotide
ggtggacgagcgaccgcatgctaat

SEQ ID NO: 739500 - DNA, 25 bp, Artificial sequence
  Synthetic oligonucleotide
atcacgctgtggattgatgatgcgc

SEQ ID NO: 739501 - DNA, 25 bp, Artificial sequence
  Synthetic oligonucleotide
gatgaaatcgaagagtcgctgaacg

SEQ ID NO: 739502 - DNA, 25 bp, Artificial sequence
  Synthetic oligonucleotide
tttaccgccagatgaaatcgaacag

SEQ ID NO: 739503 - DNA, 25 bp, Artificial sequence
  Synthetic oligonucleotide
tttaccgccagaagaaatcgaacag

SEQ ID NO: 739504 - DNA, 25 bp, Artificial sequence
  Synthetic oligonucleotide
tacccgaacgtcttcaggcgtggca

SEQ ID NO: 739505 - DNA, 25 bp, Artificial sequence
  Synthetic oligonucleotide
cgtccgcatgctaatcgctttttac

SEQ ID NO: 739506 - DNA, 25 bp, Artificial sequence
  Synthetic oligonucleotide
ggtggacgagcgtccgcatgctaat

SEQ ID NO: 739507 - DNA, 25 bp, Artificial sequence
  Synthetic oligonucleotide
tacccgaacgtcatcaggcgtggca

SEQ ID NO: 739508 - DNA, 25 bp, Artificial sequence
  Synthetic oligonucleotide
ggtttgatgatgcgctcagtgccat

SEQ ID NO: 739509 - DNA, 25 bp, Artificial sequence
  Synthetic oligonucleotide
atgatgcgctcactgccatgcgttc

SEQ ID NO: 739510 - DNA, 25 bp, Artificial sequence
  Synthetic oligonucleotide
cgtccgcatgcttatcgctttttac

SEQ ID NO: 739511 - DNA, 25 bp, Artificial sequence
  Synthetic oligonucleotide
atcttcatgaagggcgcgacccgcg

SEQ ID NO: 739512 - DNA, 25 bp, Artificial sequence
  Synthetic oligonucleotide
agttgcagcgattgcaactggcctg

SEQ ID NO: 739513 - DNA, 25 bp, Artificial sequence
  Synthetic oligonucleotide
ggtttgatgatgggctcagtgccat

SEQ ID NO: 739514 - DNA, 25 bp, Artificial sequence
  Synthetic oligonucleotide
gcgttcgcagttccagcgattgcaa

SEQ ID NO: 739515 - DNA, 25 bp, Artificial sequence
  Synthetic oligonucleotide
gcgttcgcagttgcagcgattgcaa

SEQ ID NO: 739516 - DNA, 25 bp, Artificial sequence
  Synthetic oligonucleotide
attaacgcgttcccagttgcagcga

SEQ ID NO: 739517 - DNA, 25 bp, Artificial sequence
  Synthetic oligonucleotide
atcttcatgaagcgcgcgacccgcg

SEQ ID NO: 739518 - DNA, 25 bp, Artificial sequence
  Synthetic oligonucleotide
agttgcagcgatagcaactggcctg

SEQ ID NO: 739519 - DNA, 25 bp, Artificial sequence
  Synthetic oligonucleotide
tgccacgcatcttcatgaagggcgc

SEQ ID NO: 739520 - DNA, 25 bp, Artificial sequence
  Synthetic oligonucleotide
tgccacgcatctacatgaagggcgc

SEQ ID NO: 739521 - DNA, 25 bp, Artificial sequence
  Synthetic oligonucleotide
ctcagtgccatgcgttcgctgaaag

SEQ ID NO: 739522 - DNA, 25 bp, Artificial sequence
  Synthetic oligonucleotide
ggcatcggtgccacgcatcttcatg

SEQ ID NO: 739523 - DNA, 25 bp, Artificial sequence
  Synthetic oligonucleotide
ctgaaaggcatcggtgccacgcatc

SEQ ID NO: 739524 - DNA, 25 bp, Artificial sequence
  Synthetic oligonucleotide
ctgaaaggcatccgtgccacgcatc

SEQ ID NO: 739525 - DNA, 25 bp, Artificial sequence
  Synthetic oligonucleotide
catgcgttcgctgaaaggcatcggt

SEQ ID NO: 739526 - DNA, 25 bp, Artificial sequence
  Synthetic oligonucleotide
catgcgttcgctcaaaggcatcggt

SEQ ID NO: 739527 - DNA, 25 bp, Artificial sequence
  Synthetic oligonucleotide
ctcagtgccatgggttcgctgaaag

SEQ ID NO: 739528 - DNA, 25 bp, Artificial sequence
  Synthetic oligonucleotide
ggcatcggtgcctcgcatcttcatg

SEQ ID NO: 739529 - DNA, 25 bp, Artificial sequence
  Synthetic oligonucleotide
attaacgcgttcgcagttgcagcga

SEQ ID NO: 739530 - DNA, 25 bp, Artificial sequence
  Synthetic oligonucleotide
atgatgcgctcagtgccatgcgttc

SEQ ID NO: 739531 - DNA, 25 bp, Artificial sequence
  Synthetic oligonucleotide
tgagccgccactggcgggaacgtca

SEQ ID NO: 739532 - DNA, 25 bp, Artificial sequence
  Synthetic oligonucleotide
gagtgctgacgccttactggcaatg

SEQ ID NO: 739533 - DNA, 25 bp, Artificial sequence
  Synthetic oligonucleotide
cagcggcatttgctcgggcagccgc

SEQ ID NO: 739534 - DNA, 25 bp, Artificial sequence
  Synthetic oligonucleotide
tactggcaatgcatccacagcgtaa

SEQ ID NO: 739535 - DNA, 25 bp, Artificial sequence
  Synthetic oligonucleotide
tactggcaatgcttccacagcgtaa

SEQ ID NO: 739536 - DNA, 25 bp, Artificial sequence
  Synthetic oligonucleotide
gggttgtggaccaggctggatgagc

SEQ ID NO: 739537 - DNA, 25 bp, Artificial sequence
  Synthetic oligonucleotide
tgagccgccactcgcgggaacgtca

SEQ ID NO: 739538 - DNA, 25 bp, Artificial sequence
  Synthetic oligonucleotide
gagtgctgacgcgttactggcaatg

SEQ ID NO: 739539 - DNA, 25 bp, Artificial sequence
  Synthetic oligonucleotide
gggttgtggacctggctggatgagc

SEQ ID NO: 739540 - DNA, 25 bp, Artificial sequence
  Synthetic oligonucleotide
tacagcgccagagtgctgacgcctt

SEQ ID NO: 739541 - DNA, 25 bp, Artificial sequence
  Synthetic oligonucleotide
tacagcgccagactgctgacgcctt

SEQ ID NO: 739542 - DNA, 25 bp, Artificial sequence
  Synthetic oligonucleotide
aacatgcagatctacagcgccagag

SEQ ID NO: 739543 - DNA, 25 bp, Artificial sequence
  Synthetic oligonucleotide
aacatgcagatcaacagcgccagag

SEQ ID NO: 739544 - DNA, 25 bp, Artificial sequence
  Synthetic oligonucleotide
cgcacactatgagcaacatgcagat

SEQ ID NO: 739545 - DNA, 25 bp, Artificial sequence
  Synthetic oligonucleotide
cgcacactatgaccaacatgcagat

SEQ ID NO: 739546 - DNA, 25 bp, Artificial sequence
  Synthetic oligonucleotide
gtcgggcagccgcacactatgagca

SEQ ID NO: 739547 - DNA, 25 bp, Artificial sequence
  Synthetic oligonucleotide
cagcggcatttggtcgggcagccgc

SEQ ID NO: 739548 - DNA, 25 bp, Artificial sequence
  Synthetic oligonucleotide
gccgcagaccattatctggcgggag

SEQ ID NO: 739549 - DNA, 25 bp, Artificial sequence
  Synthetic oligonucleotide
gcgcaggtgacgcccttagatctct

SEQ ID NO: 739550 - DNA, 25 bp, Artificial sequence
  Synthetic oligonucleotide
gtcgggcagccggacactatgagca

SEQ ID NO: 739551 - DNA, 25 bp, Artificial sequence
  Synthetic oligonucleotide
gatcttgcatggtgcaatctcgcag

SEQ ID NO: 739552 - DNA, 25 bp, Artificial sequence
  Synthetic oligonucleotide
agaaggatgccggagaccattatct

SEQ ID NO: 739553 - DNA, 25 bp, Artificial sequence
  Synthetic oligonucleotide
atttatccacgggactccgcgagct

SEQ ID NO: 739554 - DNA, 25 bp, Artificial sequence
  Synthetic oligonucleotide
atttatccacggcactccgcgagct

SEQ ID NO: 739555 - DNA, 25 bp, Artificial sequence
  Synthetic oligonucleotide
caatctcgcagtgcagtggtgcggt

SEQ ID NO: 739556 - DNA, 25 bp, Artificial sequence
  Synthetic oligonucleotide
gcgcaggtgacggccttagatctct

SEQ ID NO: 739557 - DNA, 25 bp, Artificial sequence
  Synthetic oligonucleotide
gatcttgcatggagcaatctcgcag

SEQ ID NO: 739558 - DNA, 25 bp, Artificial sequence
  Synthetic oligonucleotide
cgacgttcgatcttgcatggagcaa

SEQ ID NO: 739559 - DNA, 25 bp, Artificial sequence
  Synthetic oligonucleotide
cgacgttcgatcatgcatggagcaa

SEQ ID NO: 739560 - DNA, 25 bp, Artificial sequence
  Synthetic oligonucleotide
cgttagcgactgggacgttcgatct

SEQ ID NO: 739561 - DNA, 25 bp, Artificial sequence
  Synthetic oligonucleotide
gccttagatctctcgccgccaatgc

SEQ ID NO: 739562 - DNA, 25 bp, Artificial sequence
  Synthetic oligonucleotide
gccgcagaccataatctggcgggag

SEQ ID NO: 739563 - DNA, 25 bp, Artificial sequence
  Synthetic oligonucleotide
agaaggatgccgcagaccattatct

SEQ ID NO: 739564 - DNA, 25 bp, Artificial sequence
  Synthetic oligonucleotide
tgttcaggcacggcagaaggatgcc

SEQ ID NO: 739565 - DNA, 25 bp, Artificial sequence
  Synthetic oligonucleotide
tgttcaggcacgccagaaggatgcc

SEQ ID NO: 739566 - DNA, 25 bp, Artificial sequence
  Synthetic oligonucleotide
gccgccaatgcttgttcaggcacgc

SEQ ID NO: 739567 - DNA, 25 bp, Artificial sequence
  Synthetic oligonucleotide
gccgccaatgctagttcaggcacgc

SEQ ID NO: 739568 - DNA, 25 bp, Artificial sequence
  Synthetic oligonucleotide
cgttagcgactgcgacgttcgatct

SEQ ID NO: 739569 - DNA, 25 bp, Artificial sequence
  Synthetic oligonucleotide
gccttagatctcacgccgccaatgc

SEQ ID NO: 739570 - DNA, 25 bp, Artificial sequence
  Synthetic oligonucleotide
caatctcgcagtccagtggtgcggt

SEQ ID NO: 739571 - DNA, 25 bp, Artificial sequence
  Synthetic oligonucleotide
gagtgctgacgcgttactggcaatg

SEQ ID NO: 739572 - DNA, 25 bp, Artificial sequence
  Synthetic oligonucleotide
gagtgctgacgccttactggcaatg

SEQ ID NO: 739573 - DNA, 25 bp, Artificial sequence
  Synthetic oligonucleotide
tactggcaatgcatccacagcgtaa

SEQ ID NO: 739574 - DNA, 25 bp, Artificial sequence
  Synthetic oligonucleotide
tactggcaatgcttccacagcgtaa

SEQ ID NO: 739575 - DNA, 25 bp, Artificial sequence
  Synthetic oligonucleotide
gggttgtggaccaggctggatgagc

SEQ ID NO: 739576 - DNA, 25 bp, Artificial sequence
  Synthetic oligonucleotide
gggttgtggacctggctggatgagc

SEQ ID NO: 739577 - DNA, 25 bp, Artificial sequence
  Synthetic oligonucleotide
tgagccgccactggcgggaacgtca

SEQ ID NO: 739578 - DNA, 25 bp, Artificial sequence
  Synthetic oligonucleotide
cagcggcatttgctcgggcagccgc

SEQ ID NO: 739579 - DNA, 25 bp, Artificial sequence
  Synthetic oligonucleotide
tgagccgccactcgcgggaacgtca

SEQ ID NO: 739580 - DNA, 25 bp, Artificial sequence
  Synthetic oligonucleotide
tacagcgccagagtgctgacgcctt

SEQ ID NO: 739581 - DNA, 25 bp, Artificial sequence
  Synthetic oligonucleotide
tacagcgccagactgctgacgcctt

SEQ ID NO: 739582 - DNA, 25 bp, Artificial sequence
  Synthetic oligonucleotide
aacatgcagatctacagcgccagag

SEQ ID NO: 739583 - DNA, 25 bp, Artificial sequence
  Synthetic oligonucleotide
aacatgcagatcaacagcgccagag

SEQ ID NO: 739584 - DNA, 25 bp, Artificial sequence
  Synthetic oligonucleotide
cgcacactatgagcaacatgcagat

SEQ ID NO: 739585 - DNA, 25 bp, Artificial sequence
  Synthetic oligonucleotide
cgcacactatgaccaacatgcagat

SEQ ID NO: 739586 - DNA, 25 bp, Artificial sequence
  Synthetic oligonucleotide
gtcgggcagccgcacactatgagca

SEQ ID NO: 739587 - DNA, 25 bp, Artificial sequence
  Synthetic oligonucleotide
gcgcaggtgacgcccttagatctct

SEQ ID NO: 739588 - DNA, 25 bp, Artificial sequence
  Synthetic oligonucleotide
cagcggcatttggtcgggcagccgc

SEQ ID NO: 739589 - DNA, 25 bp, Artificial sequence
  Synthetic oligonucleotide
cgttagcgactgggacgttcgatct

SEQ ID NO: 739590 - DNA, 25 bp, Artificial sequence
  Synthetic oligonucleotide
gtcgggcagccggacactatgagca

SEQ ID NO: 739591 - DNA, 25 bp, Artificial sequence
  Synthetic oligonucleotide
gccgcagaccataatctggcgggag

SEQ ID NO: 739592 - DNA, 25 bp, Artificial sequence
  Synthetic oligonucleotide
atttatccacgggactccgcgagct

SEQ ID NO: 739593 - DNA, 25 bp, Artificial sequence
  Synthetic oligonucleotide
atttatccacggcactccgcgagct

SEQ ID NO: 739594 - DNA, 25 bp, Artificial sequence
  Synthetic oligonucleotide
caatctcgcagtgcagtggtgcggt

SEQ ID NO: 739595 - DNA, 25 bp, Artificial sequence
  Synthetic oligonucleotide
caatctcgcagtccagtggtgcggt

SEQ ID NO: 739596 - DNA, 25 bp, Artificial sequence
  Synthetic oligonucleotide
gatcttgcatggtgcaatctcgcag

SEQ ID NO: 739597 - DNA, 25 bp, Artificial sequence
  Synthetic oligonucleotide
gatcttgcatggagcaatctcgcag

SEQ ID NO: 739598 - DNA, 25 bp, Artificial sequence
  Synthetic oligonucleotide
cgacgttcgatcttgcatggagcaa

SEQ ID NO: 739599 - DNA, 25 bp, Artificial sequence
  Synthetic oligonucleotide
gccgcagaccattatctggcgggag

SEQ ID NO: 739600 - DNA, 25 bp, Artificial sequence
  Synthetic oligonucleotide
cgttagcgactgcgacgttcgatct

SEQ ID NO: 739601 - DNA, 25 bp, Artificial sequence
  Synthetic oligonucleotide
gcgcaggtgacggccttagatctct

SEQ ID NO: 739602 - DNA, 25 bp, Artificial sequence
  Synthetic oligonucleotide
agaaggatgccggagaccattatct

SEQ ID NO: 739603 - DNA, 25 bp, Artificial sequence
  Synthetic oligonucleotide
agaaggatgccgcagaccattatct

SEQ ID NO: 739604 - DNA, 25 bp, Artificial sequence
  Synthetic oligonucleotide
tgttcaggcacgccagaaggatgcc

SEQ ID NO: 739605 - DNA, 25 bp, Artificial sequence
  Synthetic oligonucleotide
tgttcaggcacggcagaaggatgcc

SEQ ID NO: 739606 - DNA, 25 bp, Artificial sequence
  Synthetic oligonucleotide
gccgccaatgcttgttcaggcacgc

SEQ ID NO: 739607 - DNA, 25 bp, Artificial sequence
  Synthetic oligonucleotide
gccgccaatgctagttcaggcacgc

SEQ ID NO: 739608 - DNA, 25 bp, Artificial sequence
  Synthetic oligonucleotide
gccttagatctctcgccgccaatgc

SEQ ID NO: 739609 - DNA, 25 bp, Artificial sequence
  Synthetic oligonucleotide
gccttagatctcacgccgccaatgc

SEQ ID NO: 739610 - DNA, 25 bp, Artificial sequence
  Synthetic oligonucleotide
cgacgttcgatcatgcatggagcaa

SEQ ID NO: 739611 - DNA, 25 bp, Artificial sequence
  Synthetic oligonucleotide
ccgctgctgggacagatcccctggc

SEQ ID NO: 739612 - DNA, 25 bp, Artificial sequence
  Synthetic oligonucleotide
gattcccgcgccgctgctgggagag

SEQ ID NO: 739613 - DNA, 25 bp, Artificial sequence
  Synthetic oligonucleotide
cgcgccgctgctgggagagatcccc

SEQ ID NO: 739614 - DNA, 25 bp, Artificial sequence
  Synthetic oligonucleotide
aaacgtcacgctcaatatatgacca

SEQ ID NO: 739615 - DNA, 25 bp, Artificial sequence
  Synthetic oligonucleotide
aaacgtcacgctgaatatatgacca

SEQ ID NO: 739616 - DNA, 25 bp, Artificial sequence
  Synthetic oligonucleotide
cgtcacgctgaaaatatgaccacgc

SEQ ID NO: 739617 - DNA, 25 bp, Artificial sequence
  Synthetic oligonucleotide
cgtcacgctgaatatatgaccacgc

SEQ ID NO: 739618 - DNA, 25 bp, Artificial sequence
  Synthetic oligonucleotide
acgctgaatatatgaccacgctcac

SEQ ID NO: 739619 - DNA, 25 bp, Artificial sequence
  Synthetic oligonucleotide
acgctgaatataagaccacgctcac

SEQ ID NO: 739620 - DNA, 25 bp, Artificial sequence
  Synthetic oligonucleotide
ctgaatatatgaccacgctcacccg

SEQ ID NO: 739621 - DNA, 25 bp, Artificial sequence
  Synthetic oligonucleotide
ctgaatatatgagcacgctcacccg

SEQ ID NO: 739622 - DNA, 25 bp, Artificial sequence
  Synthetic oligonucleotide
gaatatatgacctcgctcacccgca

SEQ ID NO: 739623 - DNA, 25 bp, Artificial sequence
  Synthetic oligonucleotide
gaatatatgaccacgctcacccgca

SEQ ID NO: 739624 - DNA, 25 bp, Artificial sequence
  Synthetic oligonucleotide
cccgcatgattcccgcgccgctgct

SEQ ID NO: 739625 - DNA, 25 bp, Artificial sequence
  Synthetic oligonucleotide
cccgcatgattcgcgcgccgctgct

SEQ ID NO: 739626 - DNA, 25 bp, Artificial sequence
  Synthetic oligonucleotide
gaaaacgtcacgctgaatatatgac

SEQ ID NO: 739627 - DNA, 25 bp, Artificial sequence
  Synthetic oligonucleotide
gctgggagagatcccctggcttgca

SEQ ID NO: 739628 - DNA, 25 bp, Artificial sequence
  Synthetic oligonucleotide
atcccctggcttccagaaaatccag

SEQ ID NO: 739629 - DNA, 25 bp, Artificial sequence
  Synthetic oligonucleotide
atcccctggcttgcagaaaatccag

SEQ ID NO: 739630 - DNA, 25 bp, Artificial sequence
  Synthetic oligonucleotide
gagatcccctggcttgcagaaaatc

SEQ ID NO: 739631 - DNA, 25 bp, Artificial sequence
  Synthetic oligonucleotide
gagatcccctgggttgcagaaaatc

SEQ ID NO: 739632 - DNA, 25 bp, Artificial sequence
  Synthetic oligonucleotide
ggagagatccccaggcttgcagaaa

SEQ ID NO: 739633 - DNA, 25 bp, Artificial sequence
  Synthetic oligonucleotide
catgattcccgcgccgctgctggga

SEQ ID NO: 739634 - DNA, 25 bp, Artificial sequence
  Synthetic oligonucleotide
gctgggagagatgccctggcttgca

SEQ ID NO: 739635 - DNA, 25 bp, Artificial sequence
  Synthetic oligonucleotide
catgattcccgccccgctgctggga

SEQ ID NO: 739636 - DNA, 25 bp, Artificial sequence
  Synthetic oligonucleotide
ctgctgggagagatcccctggcttg

SEQ ID NO: 739637 - DNA, 25 bp, Artificial sequence
  Synthetic oligonucleotide
ctgctgggagagttcccctggcttg

SEQ ID NO: 739638 - DNA, 25 bp, Artificial sequence
  Synthetic oligonucleotide
ccgctgctgggagagatcccctggc

SEQ ID NO: 739639 - DNA, 25 bp, Artificial sequence
  Synthetic oligonucleotide
cgcgccgctgctcggagagatcccc

SEQ ID NO: 739640 - DNA, 25 bp, Artificial sequence
  Synthetic oligonucleotide
gattcccgcgcccctgctgggagag

SEQ ID NO: 739641 - DNA, 25 bp, Artificial sequence
  Synthetic oligonucleotide
tttgcagattggctaacacaggaac

SEQ ID NO: 739642 - DNA, 25 bp, Artificial sequence
  Synthetic oligonucleotide
ggagagatcccctggcttgcagaaa

SEQ ID NO: 739643 - DNA, 25 bp, Artificial sequence
  Synthetic oligonucleotide
tttgcagattgggtaacacaggaac

SEQ ID NO: 739644 - DNA, 25 bp, Artificial sequence
  Synthetic oligonucleotide
tgacactttcacatttgcagattgg

SEQ ID NO: 739645 - DNA, 25 bp, Artificial sequence
  Synthetic oligonucleotide
tgacactttcacttttgcagattgg

SEQ ID NO: 739646 - DNA, 25 bp, Artificial sequence
  Synthetic oligonucleotide
ctttctgacactatcacttttgcag

SEQ ID NO: 739647 - DNA, 25 bp, Artificial sequence
  Synthetic oligonucleotide
ctttctgacactttcacttttgcag

SEQ ID NO: 739648 - DNA, 25 bp, Artificial sequence
  Synthetic oligonucleotide
ggtgctggcggcaggtttacgccgc

SEQ ID NO: 739649 - DNA, 25 bp, Artificial sequence
  Synthetic oligonucleotide
ggtgctggcggctggtttacgccgc

SEQ ID NO: 739650 - DNA, 25 bp, Artificial sequence
  Synthetic oligonucleotide
gaaaacgtcacggtgaatatatgac

SEQ ID NO: 739651 - DNA, 25 bp, Artificial sequence
  Synthetic oligonucleotide
cccgcatgattcccgcgccgctgct

SEQ ID NO: 739652 - DNA, 25 bp, Artificial sequence
  Synthetic oligonucleotide
cgtcacgctgaatatatgaccacgc

SEQ ID NO: 739653 - DNA, 25 bp, Artificial sequence
  Synthetic oligonucleotide
cgtcacgctgaaaatatgaccacgc

SEQ ID NO: 739654 - DNA, 25 bp, Artificial sequence
  Synthetic oligonucleotide
acgctgaatatatgaccacgctcac

SEQ ID NO: 739655 - DNA, 25 bp, Artificial sequence
  Synthetic oligonucleotide
acgctgaatataagaccacgctcac

SEQ ID NO: 739656 - DNA, 25 bp, Artificial sequence
  Synthetic oligonucleotide
ctgaatatatgagcacgctcacccg

SEQ ID NO: 739657 - DNA, 25 bp, Artificial sequence
  Synthetic oligonucleotide
ctgaatatatgaccacgctcacccg

SEQ ID NO: 739658 - DNA, 25 bp, Artificial sequence
  Synthetic oligonucleotide
aaacgtcacgctcaatatatgacca

SEQ ID NO: 739659 - DNA, 25 bp, Artificial sequence
  Synthetic oligonucleotide
gaatatatgacctcgctcacccgca

SEQ ID NO: 739660 - DNA, 25 bp, Artificial sequence
  Synthetic oligonucleotide
tttgcagattgggtaacacaggaac

SEQ ID NO: 739661 - DNA, 25 bp, Artificial sequence
  Synthetic oligonucleotide
catgattcccgccccgctgctggga

SEQ ID NO: 739662 - DNA, 25 bp, Artificial sequence
  Synthetic oligonucleotide
gaatatatgaccacgctcacccgca

SEQ ID NO: 739663 - DNA, 25 bp, Artificial sequence
  Synthetic oligonucleotide
catgattcccgcgccgctgctggga

SEQ ID NO: 739664 - DNA, 25 bp, Artificial sequence
  Synthetic oligonucleotide
aaacgtcacgctgaatatatgacca

SEQ ID NO: 739665 - DNA, 25 bp, Artificial sequence
  Synthetic oligonucleotide
gaaaacgtcacggtgaatatatgac

SEQ ID NO: 739666 - DNA, 25 bp, Artificial sequence
  Synthetic oligonucleotide
gattcccgcgccgctgctgggagag

SEQ ID NO: 739667 - DNA, 25 bp, Artificial sequence
  Synthetic oligonucleotide
tttgcagattggctaacacaggaac

SEQ ID NO: 739668 - DNA, 25 bp, Artificial sequence
  Synthetic oligonucleotide
tgacactttcacttttgcagattgg

SEQ ID NO: 739669 - DNA, 25 bp, Artificial sequence
  Synthetic oligonucleotide
tgacactttcacatttgcagattgg

SEQ ID NO: 739670 - DNA, 25 bp, Artificial sequence
  Synthetic oligonucleotide
ctttctgacactatcacttttgcag

SEQ ID NO: 739671 - DNA, 25 bp, Artificial sequence
  Synthetic oligonucleotide
ctttctgacactttcacttttgcag

SEQ ID NO: 739672 - DNA, 25 bp, Artificial sequence
  Synthetic oligonucleotide
ggtgctggcggctggtttacgccgc

SEQ ID NO: 739673 - DNA, 25 bp, Artificial sequence
  Synthetic oligonucleotide
ggtgctggcggcaggtttacgccgc

SEQ ID NO: 739674 - DNA, 25 bp, Artificial sequence
  Synthetic oligonucleotide
gaaaacgtcacgctgaatatatgac

SEQ ID NO: 739675 - DNA, 25 bp, Artificial sequence
  Synthetic oligonucleotide
ggagagatcccctggcttgcagaaa

SEQ ID NO: 739676 - DNA, 25 bp, Artificial sequence
  Synthetic oligonucleotide
gagatcccctgggttgcagaaaatc

SEQ ID NO: 739677 - DNA, 25 bp, Artificial sequence
  Synthetic oligonucleotide
atcccctggcttccagaaaatccag

SEQ ID NO: 739678 - DNA, 25 bp, Artificial sequence
  Synthetic oligonucleotide
atcccctggcttgcagaaaatccag

SEQ ID NO: 739679 - DNA, 25 bp, Artificial sequence
  Synthetic oligonucleotide
gagatcccctggcttgcagaaaatc

SEQ ID NO: 739680 - DNA, 25 bp, Artificial sequence
  Synthetic oligonucleotide
ggagagatccccaggcttgcagaaa

SEQ ID NO: 739681 - DNA, 25 bp, Artificial sequence
  Synthetic oligonucleotide
gctgggagagatgccctggcttgca

SEQ ID NO: 739682 - DNA, 25 bp, Artificial sequence
  Synthetic oligonucleotide
gctgggagagatcccctggcttgca

SEQ ID NO: 739683 - DNA, 25 bp, Artificial sequence
  Synthetic oligonucleotide
ctgctgggagagatcccctggcttg

SEQ ID NO: 739684 - DNA, 25 bp, Artificial sequence
  Synthetic oligonucleotide
ctgctgggagagttcccctggcttg

SEQ ID NO: 739685 - DNA, 25 bp, Artificial sequence
  Synthetic oligonucleotide
ccgctgctgggagagatcccctggc

SEQ ID NO: 739686 - DNA, 25 bp, Artificial sequence
  Synthetic oligonucleotide
ccgctgctgggacagatcccctggc

SEQ ID NO: 739687 - DNA, 25 bp, Artificial sequence
  Synthetic oligonucleotide
cgcgccgctgctcggagagatcccc

SEQ ID NO: 739688 - DNA, 25 bp, Artificial sequence
  Synthetic oligonucleotide
cgcgccgctgctgggagagatcccc

SEQ ID NO: 739689 - DNA, 25 bp, Artificial sequence
  Synthetic oligonucleotide
gattcccgcgcccctgctgggagag

SEQ ID NO: 739690 - DNA, 25 bp, Artificial sequence
  Synthetic oligonucleotide
cccgcatgattcgcgcgccgctgct

SEQ ID NO: 739691 - DNA, 25 bp, Artificial sequence
  Synthetic oligonucleotide
cgccagttgtgctcttttacaagcc

SEQ ID NO: 739692 - DNA, 25 bp, Artificial sequence
  Synthetic oligonucleotide
aggtttacgcaatagcgacgcgctg

SEQ ID NO: 739693 - DNA, 25 bp, Artificial sequence
  Synthetic oligonucleotide
gcgctggcgttacagcgcaacagca

SEQ ID NO: 739694 - DNA, 25 bp, Artificial sequence
  Synthetic oligonucleotide
gcgacgcgctggcgttacagcgcaa

SEQ ID NO: 739695 - DNA, 25 bp, Artificial sequence
  Synthetic oligonucleotide
gcgacgcgctggggttacagcgcaa

SEQ ID NO: 739696 - DNA, 25 bp, Artificial sequence
  Synthetic oligonucleotide
cgcaatagcgacccgctggcgttac

SEQ ID NO: 739697 - DNA, 25 bp, Artificial sequence
  Synthetic oligonucleotide
cgcaatagcgacgcgctggcgttac

SEQ ID NO: 739698 - DNA, 25 bp, Artificial sequence
  Synthetic oligonucleotide
aggtttacgcaaaagcgacgcgctg

SEQ ID NO: 739699 - DNA, 25 bp, Artificial sequence
  Synthetic oligonucleotide
gcaaaggcagcacgctaccggacgg

SEQ ID NO: 739700 - DNA, 25 bp, Artificial sequence
  Synthetic oligonucleotide
gcaaaggcagcaggctaccggacgg

SEQ ID NO: 739701 - DNA, 25 bp, Artificial sequence
  Synthetic oligonucleotide
caagccgcaaagccagcaggctacc

SEQ ID NO: 739702 - DNA, 25 bp, Artificial sequence
  Synthetic oligonucleotide
caagccgcaaaggcagcaggctacc

SEQ ID NO: 739703 - DNA, 25 bp, Artificial sequence
  Synthetic oligonucleotide
gcgctggcgttagagcgcaacagca

SEQ ID NO: 739704 - DNA, 25 bp, Artificial sequence
  Synthetic oligonucleotide
cacttttacaagccgcaaaggcagc

SEQ ID NO: 739705 - DNA, 25 bp, Artificial sequence
  Synthetic oligonucleotide
catcagcgcgcaagagggcagaccg

SEQ ID NO: 739706 - DNA, 25 bp, Artificial sequence
  Synthetic oligonucleotide
cgccagttgtgcacttttacaagcc

SEQ ID NO: 739707 - DNA, 25 bp, Artificial sequence
  Synthetic oligonucleotide
gggaaaactgtccccagttgtgcac

SEQ ID NO: 739708 - DNA, 25 bp, Artificial sequence
  Synthetic oligonucleotide
cacttttacaaggcgcaaaggcagc

SEQ ID NO: 739709 - DNA, 25 bp, Artificial sequence
  Synthetic oligonucleotide
cgcaagagggcagaccgatagaatc

SEQ ID NO: 739710 - DNA, 25 bp, Artificial sequence
  Synthetic oligonucleotide
atgagcgccggattacgcgcgcttg

SEQ ID NO: 739711 - DNA, 25 bp, Artificial sequence
  Synthetic oligonucleotide
atgagcgccggaatacgcgcgcttg

SEQ ID NO: 739712 - DNA, 25 bp, Artificial sequence
  Synthetic oligonucleotide
ttggtaatgagccccggattacgcg

SEQ ID NO: 739713 - DNA, 25 bp, Artificial sequence
  Synthetic oligonucleotide
ttggtaatgagcgccggattacgcg

SEQ ID NO: 739714 - DNA, 25 bp, Artificial sequence
  Synthetic oligonucleotide
agaatcattggtaatgagcgccgga

SEQ ID NO: 739715 - DNA, 25 bp, Artificial sequence
  Synthetic oligonucleotide
agaatcattggttatgagcgccgga

SEQ ID NO: 739716 - DNA, 25 bp, Artificial sequence
  Synthetic oligonucleotide
gaccgatagaatcattggtaatgag

SEQ ID NO: 739717 - DNA, 25 bp, Artificial sequence
  Synthetic oligonucleotide
gaccgatagaatgattggtaatgag

SEQ ID NO: 739718 - DNA, 25 bp, Artificial sequence
  Synthetic oligonucleotide
cagcagcctgcagctggattacgca

SEQ ID NO: 739719 - DNA, 25 bp, Artificial sequence
  Synthetic oligonucleotide
gggcagaccgatagaatcattggta

SEQ ID NO: 739720 - DNA, 25 bp, Artificial sequence
  Synthetic oligonucleotide
cgttacagcgcaacagcagcctgca

SEQ ID NO: 739721 - DNA, 25 bp, Artificial sequence
  Synthetic oligonucleotide
cgcaagagggcacaccgatagaatc

SEQ ID NO: 739722 - DNA, 25 bp, Artificial sequence
  Synthetic oligonucleotide
ctgcagctggattacgcaacagtaa

SEQ ID NO: 739723 - DNA, 25 bp, Artificial sequence
  Synthetic oligonucleotide
ctgcagctggataacgcaacagtaa

SEQ ID NO: 739724 - DNA, 25 bp, Artificial sequence
  Synthetic oligonucleotide
gggaaaactgtcgccagttgtgcac

SEQ ID NO: 739725 - DNA, 25 bp, Artificial sequence
  Synthetic oligonucleotide
cagcagcctgcacctggattacgca

SEQ ID NO: 739726 - DNA, 25 bp, Artificial sequence
  Synthetic oligonucleotide
agcgcaacagcagcctgcagctgga

SEQ ID NO: 739727 - DNA, 25 bp, Artificial sequence
  Synthetic oligonucleotide
agcgcaacagcaccctgcagctgga

SEQ ID NO: 739728 - DNA, 25 bp, Artificial sequence
  Synthetic oligonucleotide
cgttacagcgcatcagcagcctgca

SEQ ID NO: 739729 - DNA, 25 bp, Artificial sequence
  Synthetic oligonucleotide
gggcagaccgattgaatcattggta

SEQ ID NO: 739730 - DNA, 25 bp, Artificial sequence
  Synthetic oligonucleotide
catcagcgcgcatgagggcagaccg

SEQ ID NO: 739731 - DNA, 25 bp, Artificial sequence
  Synthetic oligonucleotide
caagccgcaaagccagcaggctacc

SEQ ID NO: 739732 - DNA, 25 bp, Artificial sequence
  Synthetic oligonucleotide
agaatcattggttatgagcgccgga

SEQ ID NO: 739733 - DNA, 25 bp, Artificial sequence
  Synthetic oligonucleotide
ttggtaatgagcgccggattacgcg

SEQ ID NO: 739734 - DNA, 25 bp, Artificial sequence
  Synthetic oligonucleotide
ttggtaatgagccccggattacgcg

SEQ ID NO: 739735 - DNA, 25 bp, Artificial sequence
  Synthetic oligonucleotide
atgagcgccggaatacgcgcgcttg

SEQ ID NO: 739736 - DNA, 25 bp, Artificial sequence
  Synthetic oligonucleotide
atgagcgccggattacgcgcgcttg

SEQ ID NO: 739737 - DNA, 25 bp, Artificial sequence
  Synthetic oligonucleotide
cgcaatagcgacgcgctggcgttac

SEQ ID NO: 739738 - DNA, 25 bp, Artificial sequence
  Synthetic oligonucleotide
aggtttacgcaatagcgacgcgctg

SEQ ID NO: 739739 - DNA, 25 bp, Artificial sequence
  Synthetic oligonucleotide
agaatcattggtaatgagcgccgga

SEQ ID NO: 739740 - DNA, 25 bp, Artificial sequence
  Synthetic oligonucleotide
caagccgcaaaggcagcaggctacc

SEQ ID NO: 739741 - DNA, 25 bp, Artificial sequence
  Synthetic oligonucleotide
aggtttacgcaaaagcgacgcgctg

SEQ ID NO: 739742 - DNA, 25 bp, Artificial sequence
  Synthetic oligonucleotide
cacttttacaaggcgcaaaggcagc

SEQ ID NO: 739743 - DNA, 25 bp, Artificial sequence
  Synthetic oligonucleotide
cacttttacaagccgcaaaggcagc

SEQ ID NO: 739744 - DNA, 25 bp, Artificial sequence
  Synthetic oligonucleotide
cgccagttgtgctcttttacaagcc

SEQ ID NO: 739745 - DNA, 25 bp, Artificial sequence
  Synthetic oligonucleotide
cgccagttgtgcacttttacaagcc

SEQ ID NO: 739746 - DNA, 25 bp, Artificial sequence
  Synthetic oligonucleotide
gggaaaactgtccccagttgtgcac

SEQ ID NO: 739747 - DNA, 25 bp, Artificial sequence
  Synthetic oligonucleotide
gggaaaactgtcgccagttgtgcac

SEQ ID NO: 739748 - DNA, 25 bp, Artificial sequence
  Synthetic oligonucleotide
cgcaatagcgacccgctggcgttac

SEQ ID NO: 739749 - DNA, 25 bp, Artificial sequence
  Synthetic oligonucleotide
gcaaaggcagcacgctaccggacgg

SEQ ID NO: 739750 - DNA, 25 bp, Artificial sequence
  Synthetic oligonucleotide
gcgctggcgttagagcgcaacagca

SEQ ID NO: 739751 - DNA, 25 bp, Artificial sequence
  Synthetic oligonucleotide
gcgacgcgctggcgttacagcgcaa

SEQ ID NO: 739752 - DNA, 25 bp, Artificial sequence
  Synthetic oligonucleotide
gcaaaggcagcaggctaccggacgg

SEQ ID NO: 739753 - DNA, 25 bp, Artificial sequence
  Synthetic oligonucleotide
gcgacgcgctggggttacagcgcaa

SEQ ID NO: 739754 - DNA, 25 bp, Artificial sequence
  Synthetic oligonucleotide
gaccgatagaatgattggtaatgag

SEQ ID NO: 739755 - DNA, 25 bp, Artificial sequence
  Synthetic oligonucleotide
gcgctggcgttacagcgcaacagca

SEQ ID NO: 739756 - DNA, 25 bp, Artificial sequence
  Synthetic oligonucleotide
cgttacagcgcatcagcagcctgca

SEQ ID NO: 739757 - DNA, 25 bp, Artificial sequence
  Synthetic oligonucleotide
cgttacagcgcaacagcagcctgca

SEQ ID NO: 739758 - DNA, 25 bp, Artificial sequence
  Synthetic oligonucleotide
agcgcaacagcaccctgcagctgga

SEQ ID NO: 739759 - DNA, 25 bp, Artificial sequence
  Synthetic oligonucleotide
agcgcaacagcagcctgcagctgga

SEQ ID NO: 739760 - DNA, 25 bp, Artificial sequence
  Synthetic oligonucleotide
cagcagcctgcagctggattacgca

SEQ ID NO: 739761 - DNA, 25 bp, Artificial sequence
  Synthetic oligonucleotide
cagcagcctgcacctggattacgca

SEQ ID NO: 739762 - DNA, 25 bp, Artificial sequence
  Synthetic oligonucleotide
gggcagaccgatagaatcattggta

SEQ ID NO: 739763 - DNA, 25 bp, Artificial sequence
  Synthetic oligonucleotide
gaccgatagaatcattggtaatgag

SEQ ID NO: 739764 - DNA, 25 bp, Artificial sequence
  Synthetic oligonucleotide
gggcagaccgattgaatcattggta

SEQ ID NO: 739765 - DNA, 25 bp, Artificial sequence
  Synthetic oligonucleotide
cgcaagagggcagaccgatagaatc

SEQ ID NO: 739766 - DNA, 25 bp, Artificial sequence
  Synthetic oligonucleotide
cgcaagagggcacaccgatagaatc

SEQ ID NO: 739767 - DNA, 25 bp, Artificial sequence
  Synthetic oligonucleotide
catcagcgcgcaagagggcagaccg

SEQ ID NO: 739768 - DNA, 25 bp, Artificial sequence
  Synthetic oligonucleotide
catcagcgcgcatgagggcagaccg

SEQ ID NO: 739769 - DNA, 25 bp, Artificial sequence
  Synthetic oligonucleotide
ctgcagctggattacgcaacagtaa

SEQ ID NO: 739770 - DNA, 25 bp, Artificial sequence
  Synthetic oligonucleotide
ctgcagctggataacgcaacagtaa

SEQ ID NO: 739771 - DNA, 25 bp, Artificial sequence
  Synthetic oligonucleotide
gtactaccagagtgtctaggaagcc

SEQ ID NO: 739772 - DNA, 25 bp, Artificial sequence
  Synthetic oligonucleotide
tcgagcggcaggcgaccccaggcat

SEQ ID NO: 739773 - DNA, 25 bp, Artificial sequence
  Synthetic oligonucleotide
ctgcgtcgtgcaccggtcgggagag

SEQ ID NO: 739774 - DNA, 25 bp, Artificial sequence
  Synthetic oligonucleotide
gcatcgcgcacatccagccgcgccc

SEQ ID NO: 739775 - DNA, 25 bp, Artificial sequence
  Synthetic oligonucleotide
ccctgcctggtgcagtactaccaga

SEQ ID NO: 739776 - DNA, 25 bp, Artificial sequence
  Synthetic oligonucleotide
cctgcctggtgcagtactaccagag

SEQ ID NO: 739777 - DNA, 25 bp, Artificial sequence
  Synthetic oligonucleotide
tgcctggtgcagtactaccagagtg

SEQ ID NO: 739778 - DNA, 25 bp, Artificial sequence
  Synthetic oligonucleotide
cctggtgcagtactaccagagtgtc

SEQ ID NO: 739779 - DNA, 25 bp, Artificial sequence
  Synthetic oligonucleotide
tggtgcagtactaccagagtgtcta

SEQ ID NO: 739780 - DNA, 25 bp, Artificial sequence
  Synthetic oligonucleotide
ccaggcatcgcgcacatccagccgc

SEQ ID NO: 739781 - DNA, 25 bp, Artificial sequence
  Synthetic oligonucleotide
cagagtgtctaggaagccctccccg

SEQ ID NO: 739782 - DNA, 25 bp, Artificial sequence
  Synthetic oligonucleotide
accagagtgtctaggaagccctccc

SEQ ID NO: 739783 - DNA, 25 bp, Artificial sequence
  Synthetic oligonucleotide
taccagagtgtctaggaagccctcc

SEQ ID NO: 739784 - DNA, 25 bp, Artificial sequence
  Synthetic oligonucleotide
tgcagtactaccagagtgtctagga

SEQ ID NO: 739785 - DNA, 25 bp, Artificial sequence
  Synthetic oligonucleotide
tactaccagagtgtctaggaagccc

SEQ ID NO: 739786 - DNA, 25 bp, Artificial sequence
  Synthetic oligonucleotide
cgctctagggccaggtcgagcggca

SEQ ID NO: 739787 - DNA, 25 bp, Artificial sequence
  Synthetic oligonucleotide
agtactaccagagtgtctaggaagc

SEQ ID NO: 739788 - DNA, 25 bp, Artificial sequence
  Synthetic oligonucleotide
gtgcagtactaccagagtgtctagg

SEQ ID NO: 739789 - DNA, 25 bp, Artificial sequence
  Synthetic oligonucleotide
gaaacgttcccagcggaggagagta

SEQ ID NO: 739790 - DNA, 25 bp, Artificial sequence
  Synthetic oligonucleotide
ctaccagagtgtctaggaagccctc

SEQ ID NO: 739791 - DNA, 25 bp, Artificial sequence
  Synthetic oligonucleotide
gagtagataccgcaaataccgcacg

SEQ ID NO: 739792 - DNA, 25 bp, Artificial sequence
  Synthetic oligonucleotide
cgttcccagcggaggagagtagata

SEQ ID NO: 739793 - DNA, 25 bp, Artificial sequence
  Synthetic oligonucleotide
gcagtactaccagagtgtctaggaa

SEQ ID NO: 739794 - DNA, 25 bp, Artificial sequence
  Synthetic oligonucleotide
tcccagcggaggagagtagataccg

SEQ ID NO: 739795 - DNA, 25 bp, Artificial sequence
  Synthetic oligonucleotide
cccagcggaggagagtagataccgc

SEQ ID NO: 739796 - DNA, 25 bp, Artificial sequence
  Synthetic oligonucleotide
ccagcggaggagagtagataccgca

SEQ ID NO: 739797 - DNA, 25 bp, Artificial sequence
  Synthetic oligonucleotide
cggaggagagtagataccgcaaata

SEQ ID NO: 739798 - DNA, 25 bp, Artificial sequence
  Synthetic oligonucleotide
ttcccagcggaggagagtagatacc

SEQ ID NO: 739799 - DNA, 25 bp, Artificial sequence
  Synthetic oligonucleotide
ggagagtagataccgcaaataccgc

SEQ ID NO: 739800 - DNA, 25 bp, Artificial sequence
  Synthetic oligonucleotide
tgtccccgctctagggccaggtcga

SEQ ID NO: 739801 - DNA, 25 bp, Artificial sequence
  Synthetic oligonucleotide
agtagataccgcaaataccgcacga

SEQ ID NO: 739802 - DNA, 25 bp, Artificial sequence
  Synthetic oligonucleotide
tagataccgcaaataccgcacgacg

SEQ ID NO: 739803 - DNA, 25 bp, Artificial sequence
  Synthetic oligonucleotide
gataccgcaaataccgcacgacgtc

SEQ ID NO: 739804 - DNA, 25 bp, Artificial sequence
  Synthetic oligonucleotide
ataccgcaaataccgcacgacgtcg

SEQ ID NO: 739805 - DNA, 25 bp, Artificial sequence
  Synthetic oligonucleotide
ccgcaaataccgcacgacgtcgtga

SEQ ID NO: 739806 - DNA, 25 bp, Artificial sequence
  Synthetic oligonucleotide
gcaaataccgcacgacgtcgtgatg

SEQ ID NO: 739807 - DNA, 25 bp, Artificial sequence
  Synthetic oligonucleotide
aaataccgcacgacgtcgtgatgtc

SEQ ID NO: 739808 - DNA, 25 bp, Artificial sequence
  Synthetic oligonucleotide
ataccgcacgacgtcgtgatgtccc

SEQ ID NO: 739809 - DNA, 25 bp, Artificial sequence
  Synthetic oligonucleotide
acgacgtcgtgatgtccccgctcta

SEQ ID NO: 739810 - DNA, 25 bp, Artificial sequence
  Synthetic oligonucleotide
gaggagagtagataccgcaaatacc

SEQ ID NO: 739811 - DNA, 25 bp, Artificial sequence
  Synthetic oligonucleotide
ccgaggcctaaatgccggagaagcc

SEQ ID NO: 739812 - DNA, 25 bp, Artificial sequence
  Synthetic oligonucleotide
tctgaaattcccgcgctcttcgtcg

SEQ ID NO: 739813 - DNA, 25 bp, Artificial sequence
  Synthetic oligonucleotide
cgaggcctaaatgccggagaagccc

SEQ ID NO: 739814 - DNA, 25 bp, Artificial sequence
  Synthetic oligonucleotide
aacgccgaggcctaaatgccggaga

SEQ ID NO: 739815 - DNA, 25 bp, Artificial sequence
  Synthetic oligonucleotide
gctagcctttcggaacaagagatct

SEQ ID NO: 739816 - DNA, 25 bp, Artificial sequence
  Synthetic oligonucleotide
tctagacacgtcagcggaagggaga

SEQ ID NO: 739817 - DNA, 25 bp, Artificial sequence
  Synthetic oligonucleotide
gatctagacacgtcagcggaaggga

SEQ ID NO: 739818 - DNA, 25 bp, Artificial sequence
  Synthetic oligonucleotide
ccgcttggcgcctagtgctagcctt

SEQ ID NO: 739819 - DNA, 25 bp, Artificial sequence
  Synthetic oligonucleotide
cggaacaagagatctagacacgtca

SEQ ID NO: 739820 - DNA, 25 bp, Artificial sequence
  Synthetic oligonucleotide
tcggaacaagagatctagacacgtc

SEQ ID NO: 739821 - DNA, 25 bp, Artificial sequence
  Synthetic oligonucleotide
tttcggaacaagagatctagacacg

SEQ ID NO: 739822 - DNA, 25 bp, Artificial sequence
  Synthetic oligonucleotide
tctatctgaaattcccgcgctcttc

SEQ ID NO: 739823 - DNA, 25 bp, Artificial sequence
  Synthetic oligonucleotide
agcctttcggaacaagagatctaga

SEQ ID NO: 739824 - DNA, 25 bp, Artificial sequence
  Synthetic oligonucleotide
gaaaccggccgcttggcgcctagtg

SEQ ID NO: 739825 - DNA, 25 bp, Artificial sequence
  Synthetic oligonucleotide
agtgctagcctttcggaacaagaga

SEQ ID NO: 739826 - DNA, 25 bp, Artificial sequence
  Synthetic oligonucleotide
ctagtgctagcctttcggaacaaga

SEQ ID NO: 739827 - DNA, 25 bp, Artificial sequence
  Synthetic oligonucleotide
cctagtgctagcctttcggaacaag

SEQ ID NO: 739828 - DNA, 25 bp, Artificial sequence
  Synthetic oligonucleotide
cgcctagtgctagcctttcggaaca

SEQ ID NO: 739829 - DNA, 25 bp, Artificial sequence
  Synthetic oligonucleotide
ggcgcctagtgctagcctttcggaa

SEQ ID NO: 739830 - DNA, 25 bp, Artificial sequence
  Synthetic oligonucleotide
ttggcgcctagtgctagcctttcgg

SEQ ID NO: 739831 - DNA, 25 bp, Artificial sequence
  Synthetic oligonucleotide
gcttggcgcctagtgctagcctttc

SEQ ID NO: 739832 - DNA, 25 bp, Artificial sequence
  Synthetic oligonucleotide
cctttcggaacaagagatctagaca

SEQ ID NO: 739833 - DNA, 25 bp, Artificial sequence
  Synthetic oligonucleotide
agccgcaattacaatctatctgaaa

SEQ ID NO: 739834 - DNA, 25 bp, Artificial sequence
  Synthetic oligonucleotide
ggagataggtcttcgagttgcacca

SEQ ID NO: 739835 - DNA, 25 bp, Artificial sequence
  Synthetic oligonucleotide
agataggtcttcgagttgcaccagc

SEQ ID NO: 739836 - DNA, 25 bp, Artificial sequence
  Synthetic oligonucleotide
ataggtcttcgagttgcaccagcgg

SEQ ID NO: 739837 - DNA, 25 bp, Artificial sequence
  Synthetic oligonucleotide
taggtcttcgagttgcaccagcggc

SEQ ID NO: 739838 - DNA, 25 bp, Artificial sequence
  Synthetic oligonucleotide
gtcttcgagttgcaccagcggccac

SEQ ID NO: 739839 - DNA, 25 bp, Artificial sequence
  Synthetic oligonucleotide
accgcgcagccgcaattacaatcta

SEQ ID NO: 739840 - DNA, 25 bp, Artificial sequence
  Synthetic oligonucleotide
cgcgcagccgcaattacaatctatc

SEQ ID NO: 739841 - DNA, 25 bp, Artificial sequence
  Synthetic oligonucleotide
ggagaggaggagcaagttgaggcgt

SEQ ID NO: 739842 - DNA, 25 bp, Artificial sequence
  Synthetic oligonucleotide
gcagccgcaattacaatctatctga

SEQ ID NO: 739843 - DNA, 25 bp, Artificial sequence
  Synthetic oligonucleotide
aaccggccgcttggcgcctagtgct

SEQ ID NO: 739844 - DNA, 25 bp, Artificial sequence
  Synthetic oligonucleotide
ttacaatctatctgaaattcccgcg

SEQ ID NO: 739845 - DNA, 25 bp, Artificial sequence
  Synthetic oligonucleotide
caatctatctgaaattcccgcgctc

SEQ ID NO: 739846 - DNA, 25 bp, Artificial sequence
  Synthetic oligonucleotide
cgccgaggcctaaatgccggagaag

SEQ ID NO: 739847 - DNA, 25 bp, Artificial sequence
  Synthetic oligonucleotide
ctatctgaaattcccgcgctcttcg

SEQ ID NO: 739848 - DNA, 25 bp, Artificial sequence
  Synthetic oligonucleotide
gctcttcgtcgccaaggaaaccggc

SEQ ID NO: 739849 - DNA, 25 bp, Artificial sequence
  Synthetic oligonucleotide
aggagataggtcttcgagttgcacc

SEQ ID NO: 739850 - DNA, 25 bp, Artificial sequence
  Synthetic oligonucleotide
gcgcagccgcaattacaatctatct

SEQ ID NO: 739851 - DNA, 25 bp, Artificial sequence
  Synthetic oligonucleotide
ctttcctagaccgacacgccgccgc

SEQ ID NO: 739852 - DNA, 25 bp, Artificial sequence
  Synthetic oligonucleotide
acaggaaatcttcgggggaccaatg

SEQ ID NO: 739853 - DNA, 25 bp, Artificial sequence
  Synthetic oligonucleotide
gggcacccgagctgacattggacag

SEQ ID NO: 739854 - DNA, 25 bp, Artificial sequence
  Synthetic oligonucleotide
cccttagttccacgacttctcggtg

SEQ ID NO: 739855 - DNA, 25 bp, Artificial sequence
  Synthetic oligonucleotide
gttccacgacttctcggtgcgcaaa

SEQ ID NO: 739856 - DNA, 25 bp, Artificial sequence
  Synthetic oligonucleotide
acgacttctcggtgcgcaaactcca

SEQ ID NO: 739857 - DNA, 25 bp, Artificial sequence
  Synthetic oligonucleotide
gcgcaaactccacccggacgcggga

SEQ ID NO: 739858 - DNA, 25 bp, Artificial sequence
  Synthetic oligonucleotide
ggcagttggctgtagctttaaaccc

SEQ ID NO: 739859 - DNA, 25 bp, Artificial sequence
  Synthetic oligonucleotide
ggacgcgggacacccacaagtcgcg

SEQ ID NO: 739860 - DNA, 25 bp, Artificial sequence
  Synthetic oligonucleotide
ctaggtcatggtcgccacttgggcc

SEQ ID NO: 739861 - DNA, 25 bp, Artificial sequence
  Synthetic oligonucleotide
gcacgaagtcgggacaggaaatctt

SEQ ID NO: 739862 - DNA, 25 bp, Artificial sequence
  Synthetic oligonucleotide
ggccgctaggtcatggtcgccactt

SEQ ID NO: 739863 - DNA, 25 bp, Artificial sequence
  Synthetic oligonucleotide
gggagtcgaacttcaggcagaaaga

SEQ ID NO: 739864 - DNA, 25 bp, Artificial sequence
  Synthetic oligonucleotide
cttcaggcagaaagatgctgtccgc

SEQ ID NO: 739865 - DNA, 25 bp, Artificial sequence
  Synthetic oligonucleotide
cagaaagatgctgtccgcgagagaa

SEQ ID NO: 739866 - DNA, 25 bp, Artificial sequence
  Synthetic oligonucleotide
atgctgtccgcgagagaaaactcca

SEQ ID NO: 739867 - DNA, 25 bp, Artificial sequence
  Synthetic oligonucleotide
tgtccgcgagagaaaactccacgcc

SEQ ID NO: 739868 - DNA, 25 bp, Artificial sequence
  Synthetic oligonucleotide
tccacgccgacaccgccctcggagg

SEQ ID NO: 739869 - DNA, 25 bp, Artificial sequence
  Synthetic oligonucleotide
ctcgcgcctcactcgcgggcgctgt

SEQ ID NO: 739870 - DNA, 25 bp, Artificial sequence
  Synthetic oligonucleotide
acacccacaagtcgcgggcacgaag

SEQ ID NO: 739871 - DNA, 25 bp, Artificial sequence
  Synthetic oligonucleotide
gggagcgccaattcttttcaagttc

SEQ ID NO: 739872 - DNA, 25 bp, Artificial sequence
  Synthetic oligonucleotide
tcgcacgtctcaacggtggacacgc

SEQ ID NO: 739873 - DNA, 25 bp, Artificial sequence
  Synthetic oligonucleotide
cgcggcagttggctgtagctttaaa

SEQ ID NO: 739874 - DNA, 25 bp, Artificial sequence
  Synthetic oligonucleotide
cgccgcaatcaccaacgcggattgg

SEQ ID NO: 739875 - DNA, 25 bp, Artificial sequence
  Synthetic oligonucleotide
caacgcggattggactatttggatc

SEQ ID NO: 739876 - DNA, 25 bp, Artificial sequence
  Synthetic oligonucleotide
actatttggatctgggtgggcaccc

SEQ ID NO: 739877 - DNA, 25 bp, Artificial sequence
  Synthetic oligonucleotide
ctgacattggacagctcgggttcca

SEQ ID NO: 739878 - DNA, 25 bp, Artificial sequence
  Synthetic oligonucleotide
cacgtccatcctggcccactctttg

SEQ ID NO: 739879 - DNA, 25 bp, Artificial sequence
  Synthetic oligonucleotide
gaggacggtccgctccgtccatgtc

SEQ ID NO: 739880 - DNA, 25 bp, Artificial sequence
  Synthetic oligonucleotide
cttcgggagcgccaattcttttcaa

SEQ ID NO: 739881 - DNA, 25 bp, Artificial sequence
  Synthetic oligonucleotide
ccgtcgtcgcacgtctcaacggtgg

SEQ ID NO: 739882 - DNA, 25 bp, Artificial sequence
  Synthetic oligonucleotide
gcgccaattcttttcaagttcaaat

SEQ ID NO: 739883 - DNA, 25 bp, Artificial sequence
  Synthetic oligonucleotide
cacccgcttcttccaaatgttcaag

SEQ ID NO: 739884 - DNA, 25 bp, Artificial sequence
  Synthetic oligonucleotide
cttcttccaaatgttcaagaagggg

SEQ ID NO: 739885 - DNA, 25 bp, Artificial sequence
  Synthetic oligonucleotide
tttcctgggcgccaattcttcactt

SEQ ID NO: 739886 - DNA, 25 bp, Artificial sequence
  Synthetic oligonucleotide
cccttttcttctaggtgctcaggga

SEQ ID NO: 739887 - DNA, 25 bp, Artificial sequence
  Synthetic oligonucleotide
cttctaggtgctcagggagaaaaaa

SEQ ID NO: 739888 - DNA, 25 bp, Artificial sequence
  Synthetic oligonucleotide
ctgcttccgacggaggcgacggtcc

SEQ ID NO: 739889 - DNA, 25 bp, Artificial sequence
  Synthetic oligonucleotide
ctggcccactctttgtcctcgtccc

SEQ ID NO: 739890 - DNA, 25 bp, Artificial sequence
  Synthetic oligonucleotide
tcaccaacgcggattggactatttg

SEQ ID NO: 739891 - DNA, 25 bp, Artificial sequence
  Synthetic oligonucleotide
gcgagcatgtgcacgcttccgttcc

SEQ ID NO: 739892 - DNA, 25 bp, Artificial sequence
  Synthetic oligonucleotide
agagaccatcactaggccaccggtt

SEQ ID NO: 739893 - DNA, 25 bp, Artificial sequence
  Synthetic oligonucleotide
tagcgccggtgctgcagtccgagct

SEQ ID NO: 739894 - DNA, 25 bp, Artificial sequence
  Synthetic oligonucleotide
ctcaaagttgccgagcgctagcgcc

SEQ ID NO: 739895 - DNA, 25 bp, Artificial sequence
  Synthetic oligonucleotide
ttttcctcaaagttgccgagcgcta

SEQ ID NO: 739896 - DNA, 25 bp, Artificial sequence
  Synthetic oligonucleotide
gggactgccgctcttttcctcaaag

SEQ ID NO: 739897 - DNA, 25 bp, Artificial sequence
  Synthetic oligonucleotide
agtcatggtagctgctgtggtccgc

SEQ ID NO: 739898 - DNA, 25 bp, Artificial sequence
  Synthetic oligonucleotide
cccaagccagggagtcatggtagct

SEQ ID NO: 739899 - DNA, 25 bp, Artificial sequence
  Synthetic oligonucleotide
ctcactcgccgggtttaaccgtgca

SEQ ID NO: 739900 - DNA, 25 bp, Artificial sequence
  Synthetic oligonucleotide
ctccagcagctcaggagcaggacaa

SEQ ID NO: 739901 - DNA, 25 bp, Artificial sequence
  Synthetic oligonucleotide
ccgggtttaaccgtgcactgtgcac

SEQ ID NO: 739902 - DNA, 25 bp, Artificial sequence
  Synthetic oligonucleotide
tgtcggagttgcagaaggcatcctg

SEQ ID NO: 739903 - DNA, 25 bp, Artificial sequence
  Synthetic oligonucleotide
taccgatgtcggagttgcagaaggc

SEQ ID NO: 739904 - DNA, 25 bp, Artificial sequence
  Synthetic oligonucleotide
ctcccagagcgcttaccgatgtcgg

SEQ ID NO: 739905 - DNA, 25 bp, Artificial sequence
  Synthetic oligonucleotide
ggcgtgcaacttgctccggggcctc

SEQ ID NO: 739906 - DNA, 25 bp, Artificial sequence
  Synthetic oligonucleotide
cgctgcggcgtgcaacttgctccgg

SEQ ID NO: 739907 - DNA, 25 bp, Artificial sequence
  Synthetic oligonucleotide
aaggcatttctgtacatagagtccc

SEQ ID NO: 739908 - DNA, 25 bp, Artificial sequence
  Synthetic oligonucleotide
ttgggttccgtctgcaaggcatttc

SEQ ID NO: 739909 - DNA, 25 bp, Artificial sequence
  Synthetic oligonucleotide
aggagcaggacaagcccaagccagg

SEQ ID NO: 739910 - DNA, 25 bp, Artificial sequence
  Synthetic oligonucleotide
cgctgcccactgtgagcaagagtcc

SEQ ID NO: 739911 - DNA, 25 bp, Artificial sequence
  Synthetic oligonucleotide
cgcccaccggccctctttgcgcttt

SEQ ID NO: 739912 - DNA, 25 bp, Artificial sequence
  Synthetic oligonucleotide
gcgtcctgggccagtatgcgctgca

SEQ ID NO: 739913 - DNA, 25 bp, Artificial sequence
  Synthetic oligonucleotide
ataatgcagttgtgggcacgcgagt

SEQ ID NO: 739914 - DNA, 25 bp, Artificial sequence
  Synthetic oligonucleotide
ccttttagggaataatgcagttgtg

SEQ ID NO: 739915 - DNA, 25 bp, Artificial sequence
  Synthetic oligonucleotide
gttcagatccttttagggaataatg

SEQ ID NO: 739916 - DNA, 25 bp, Artificial sequence
  Synthetic oligonucleotide
ggagccggcccggaccgttcagatc

SEQ ID NO: 739917 - DNA, 25 bp, Artificial sequence
  Synthetic oligonucleotide
tggcagcgccgcattacctcatcgg

SEQ ID NO: 739918 - DNA, 25 bp, Artificial sequence
  Synthetic oligonucleotide
agtccgagctcactcgccgggttta

SEQ ID NO: 739919 - DNA, 25 bp, Artificial sequence
  Synthetic oligonucleotide
gagtccagggctgcagagtgatata

SEQ ID NO: 739920 - DNA, 25 bp, Artificial sequence
  Synthetic oligonucleotide
catcactaggccaccggttgggttc

SEQ ID NO: 739921 - DNA, 25 bp, Artificial sequence
  Synthetic oligonucleotide
tgcccgctgcccactgtgagcaaga

SEQ ID NO: 739922 - DNA, 25 bp, Artificial sequence
  Synthetic oligonucleotide
tctggcgcacgagtccgcggagcca

SEQ ID NO: 739923 - DNA, 25 bp, Artificial sequence
  Synthetic oligonucleotide
ccaagggtgtctggcgcacgagtcc

SEQ ID NO: 739924 - DNA, 25 bp, Artificial sequence
  Synthetic oligonucleotide
atgtgaccaagtggccaagggtgtc

SEQ ID NO: 739925 - DNA, 25 bp, Artificial sequence
  Synthetic oligonucleotide
tgccttccaagtagcccggcgggat

SEQ ID NO: 739926 - DNA, 25 bp, Artificial sequence
  Synthetic oligonucleotide
gctccggggaagtgccttccaagta

SEQ ID NO: 739927 - DNA, 25 bp, Artificial sequence
  Synthetic oligonucleotide
caactttgagctccggggaagtgcc

SEQ ID NO: 739928 - DNA, 25 bp, Artificial sequence
  Synthetic oligonucleotide
gcactgtgcacggtgggcaactttg

SEQ ID NO: 739929 - DNA, 25 bp, Artificial sequence
  Synthetic oligonucleotide
tctgaccaatggcagcgccgcatta

SEQ ID NO: 739930 - DNA, 25 bp, Artificial sequence
  Synthetic oligonucleotide
cgtctgcaaggcatttctgtacata

SEQ ID NO: 739931 - DNA, 25 bp, Artificial sequence
  Synthetic oligonucleotide
gcctctcggttggtccagacaaaaa

SEQ ID NO: 739932 - DNA, 25 bp, Artificial sequence
  Synthetic oligonucleotide
gcagcacgacaagtagtggctactg

SEQ ID NO: 739933 - DNA, 25 bp, Artificial sequence
  Synthetic oligonucleotide
gccgtgcacattgaacatcccaatt

SEQ ID NO: 739934 - DNA, 25 bp, Artificial sequence
  Synthetic oligonucleotide
tccacgcagtggactaaggtcgggc

SEQ ID NO: 739935 - DNA, 25 bp, Artificial sequence
  Synthetic oligonucleotide
ggttggaagctctccacgcagtgga

SEQ ID NO: 739936 - DNA, 25 bp, Artificial sequence
  Synthetic oligonucleotide
ctcggcatcacagacgctagttttg

SEQ ID NO: 739937 - DNA, 25 bp, Artificial sequence
  Synthetic oligonucleotide
gctagttttgcttgcgggtttgcca

SEQ ID NO: 739938 - DNA, 25 bp, Artificial sequence
  Synthetic oligonucleotide
tgggcgaggctgaaacaccttcctt

SEQ ID NO: 739939 - DNA, 25 bp, Artificial sequence
  Synthetic oligonucleotide
acaccttccttcgaaatgacctgga

SEQ ID NO: 739940 - DNA, 25 bp, Artificial sequence
  Synthetic oligonucleotide
gggttaatcccgacgccgtgcacat

SEQ ID NO: 739941 - DNA, 25 bp, Artificial sequence
  Synthetic oligonucleotide
gaaacgtatgtaggggtctctgttc

SEQ ID NO: 739942 - DNA, 25 bp, Artificial sequence
  Synthetic oligonucleotide
tcgtctgcctggactgctgcgggcc

SEQ ID NO: 739943 - DNA, 25 bp, Artificial sequence
  Synthetic oligonucleotide
ctctcatcgcgagcctctcggttgg

SEQ ID NO: 739944 - DNA, 25 bp, Artificial sequence
  Synthetic oligonucleotide
agagttagttggtgggcagcctccc

SEQ ID NO: 739945 - DNA, 25 bp, Artificial sequence
  Synthetic oligonucleotide
taagttgcggcctggagagttagtt

SEQ ID NO: 739946 - DNA, 25 bp, Artificial sequence
  Synthetic oligonucleotide
acttcacggcgcgtacctcgctggt

SEQ ID NO: 739947 - DNA, 25 bp, Artificial sequence
  Synthetic oligonucleotide
cagagctcgagcagtacttcacggc

SEQ ID NO: 739948 - DNA, 25 bp, Artificial sequence
  Synthetic oligonucleotide
aggaggactcggactcagagctcga

SEQ ID NO: 739949 - DNA, 25 bp, Artificial sequence
  Synthetic oligonucleotide
gtggctactgcagccaggaggactc

SEQ ID NO: 739950 - DNA, 25 bp, Artificial sequence
  Synthetic oligonucleotide
atgacctggagcagcacgacaagta

SEQ ID NO: 739951 - DNA, 25 bp, Artificial sequence
  Synthetic oligonucleotide
tcctccagctgtagcgttgtgtccc

SEQ ID NO: 739952 - DNA, 25 bp, Artificial sequence
  Synthetic oligonucleotide
aggtgcggactccacgccaaatcta

SEQ ID NO: 739953 - DNA, 25 bp, Artificial sequence
  Synthetic oligonucleotide
aaatctacagcccacaaactaccga

SEQ ID NO: 739954 - DNA, 25 bp, Artificial sequence
  Synthetic oligonucleotide
taccgaccgcaaagacgcgccttgg

SEQ ID NO: 739955 - DNA, 25 bp, Artificial sequence
  Synthetic oligonucleotide
aaagacgcgccttggcagggtgctc

SEQ ID NO: 739956 - DNA, 25 bp, Artificial sequence
  Synthetic oligonucleotide
acttccggccctgaggcaacatcgg

SEQ ID NO: 739957 - DNA, 25 bp, Artificial sequence
  Synthetic oligonucleotide
ccctgaggcaacatcggtgcacatg

SEQ ID NO: 739958 - DNA, 25 bp, Artificial sequence
  Synthetic oligonucleotide
ggcaacatcggtgcacatgcgcaca

SEQ ID NO: 739959 - DNA, 25 bp, Artificial sequence
  Synthetic oligonucleotide
gagccaggttgagatgcctctgaga

SEQ ID NO: 739960 - DNA, 25 bp, Artificial sequence
  Synthetic oligonucleotide
tcccgacgccgtgcacattgaacat

SEQ ID NO: 739961 - DNA, 25 bp, Artificial sequence
  Synthetic oligonucleotide
aggtcattcctccagctgtagcgtt

SEQ ID NO: 739962 - DNA, 25 bp, Artificial sequence
  Synthetic oligonucleotide
cccaattatcgatttctcggcatca

SEQ ID NO: 739963 - DNA, 25 bp, Artificial sequence
  Synthetic oligonucleotide
cccttgacactagagctggagtcgg

SEQ ID NO: 739964 - DNA, 25 bp, Artificial sequence
  Synthetic oligonucleotide
cactagagctggagtcgggctgcct

SEQ ID NO: 739965 - DNA, 25 bp, Artificial sequence
  Synthetic oligonucleotide
cgggctgcctacgtttcagtcctaa

SEQ ID NO: 739966 - DNA, 25 bp, Artificial sequence
  Synthetic oligonucleotide
tttcagtcctaacggttgcggcgcg

SEQ ID NO: 739967 - DNA, 25 bp, Artificial sequence
  Synthetic oligonucleotide
gcctcggcgcaagcgcgtactgaca

SEQ ID NO: 739968 - DNA, 25 bp, Artificial sequence
  Synthetic oligonucleotide
aagcgcgtactgacacgctcacacg

SEQ ID NO: 739969 - DNA, 25 bp, Artificial sequence
  Synthetic oligonucleotide
atgtcgtgcgctcgtctgcctggac

SEQ ID NO: 739970 - DNA, 25 bp, Artificial sequence
  Synthetic oligonucleotide
tgcctctgagatgaggtcattcctc

SEQ ID NO: 739971 - DNA, 25 bp, Artificial sequence
  Synthetic oligonucleotide
ctcgcaatcggggaactcggctccg

SEQ ID NO: 739972 - DNA, 25 bp, Artificial sequence
  Synthetic oligonucleotide
catctctttgatagcattggccggc

SEQ ID NO: 739973 - DNA, 25 bp, Artificial sequence
  Synthetic oligonucleotide
cccgcgcatagtgggaagccggcct

SEQ ID NO: 739974 - DNA, 25 bp, Artificial sequence
  Synthetic oligonucleotide
cagtgcccagctccctgcatggtag

SEQ ID NO: 739975 - DNA, 25 bp, Artificial sequence
  Synthetic oligonucleotide
catggtagccgactgcagcaggtcc

SEQ ID NO: 739976 - DNA, 25 bp, Artificial sequence
  Synthetic oligonucleotide
cagcaggtccgtccaggctcgcaat

SEQ ID NO: 739977 - DNA, 25 bp, Artificial sequence
  Synthetic oligonucleotide
tggataacttctcccgccgctatgc

SEQ ID NO: 739978 - DNA, 25 bp, Artificial sequence
  Synthetic oligonucleotide
ccagcgttacctggtggtggagcct

SEQ ID NO: 739979 - DNA, 25 bp, Artificial sequence
  Synthetic oligonucleotide
attggccggccgctggataacttct

SEQ ID NO: 739980 - DNA, 25 bp, Artificial sequence
  Synthetic oligonucleotide
ccttcccagcggcaagtgctgattg

SEQ ID NO: 739981 - DNA, 25 bp, Artificial sequence
  Synthetic oligonucleotide
acggtccgctcttcctattggctca

SEQ ID NO: 739982 - DNA, 25 bp, Artificial sequence
  Synthetic oligonucleotide
tcactccggaggagagagctacgcg

SEQ ID NO: 739983 - DNA, 25 bp, Artificial sequence
  Synthetic oligonucleotide
tgcccaccgggttggaaggcaacgc

SEQ ID NO: 739984 - DNA, 25 bp, Artificial sequence
  Synthetic oligonucleotide
tgaggcgccactacgaagccgaaca

SEQ ID NO: 739985 - DNA, 25 bp, Artificial sequence
  Synthetic oligonucleotide
gcctcttacgtcagttcctggggta

SEQ ID NO: 739986 - DNA, 25 bp, Artificial sequence
  Synthetic oligonucleotide
attggctcattcctgagagctgagg

SEQ ID NO: 739987 - DNA, 25 bp, Artificial sequence
  Synthetic oligonucleotide
tgctgattgggcagaataaatgcca

SEQ ID NO: 739988 - DNA, 25 bp, Artificial sequence
  Synthetic oligonucleotide
cgcttgcgcgtcaaagttcacggtc

SEQ ID NO: 739989 - DNA, 25 bp, Artificial sequence
  Synthetic oligonucleotide
tcggctcctcaagcgcaagttcttc

SEQ ID NO: 739990 - DNA, 25 bp, Artificial sequence
  Synthetic oligonucleotide
ggcgcccgattttgccatcagccaa

SEQ ID NO: 739991 - DNA, 25 bp, Artificial sequence
  Synthetic oligonucleotide
actcctgctacaaacgccatattgg

SEQ ID NO: 739992 - DNA, 25 bp, Artificial sequence
  Synthetic oligonucleotide
ggcgccgaataactcctgctacaaa

SEQ ID NO: 739993 - DNA, 25 bp, Artificial sequence
  Synthetic oligonucleotide
accgtctcgtccaggcgccgaataa

SEQ ID NO: 739994 - DNA, 25 bp, Artificial sequence
  Synthetic oligonucleotide
gccgctatgcgattcactaccgtct

SEQ ID NO: 739995 - DNA, 25 bp, Artificial sequence
  Synthetic oligonucleotide
aaatgccagtcaatcgcctcttacg

SEQ ID NO: 739996 - DNA, 25 bp, Artificial sequence
  Synthetic oligonucleotide
gcctctactcgggaacgcgacgtga

SEQ ID NO: 739997 - DNA, 25 bp, Artificial sequence
  Synthetic oligonucleotide
tttggctgccgttctcactccggag

SEQ ID NO: 739998 - DNA, 25 bp, Artificial sequence
  Synthetic oligonucleotide
ggcgacatgtctttggctgccgttc

SEQ ID NO: 739999 - DNA, 25 bp, Artificial sequence
  Synthetic oligonucleotide
tggggtatctgttccgccctaaaca

SEQ ID NO: 740000 - DNA, 25 bp, Artificial sequence
  Synthetic oligonucleotide
aagccgaacacgaattctacgaacg

SEQ ID NO: 740001 - DNA, 25 bp, Artificial sequence
  Synthetic oligonucleotide
gagctgagggaatacgaaatctcta

SEQ ID NO: 740002 - DNA, 25 bp, Artificial sequence
  Synthetic oligonucleotide
tcggcccgagtggacccagcgttac

SEQ ID NO: 740003 - DNA, 25 bp, Artificial sequence
  Synthetic oligonucleotide
acgaggctctggtgtttcggcccga

SEQ ID NO: 740004 - DNA, 25 bp, Artificial sequence
  Synthetic oligonucleotide
tacgaaatctctagccaataggagc

SEQ ID NO: 740005 - DNA, 25 bp, Artificial sequence
  Synthetic oligonucleotide
gatgacgcccaagaggattaggatg

SEQ ID NO: 740006 - DNA, 25 bp, Artificial sequence
  Synthetic oligonucleotide
tccgcagaatgtggatgacgcccaa

SEQ ID NO: 740007 - DNA, 25 bp, Artificial sequence
  Synthetic oligonucleotide
tatcccttggcctccgcagaatgtg

SEQ ID NO: 740008 - DNA, 25 bp, Artificial sequence
  Synthetic oligonucleotide
cagagctcggcgttatcccttggcc

SEQ ID NO: 740009 - DNA, 25 bp, Artificial sequence
  Synthetic oligonucleotide
caccctgctcgggtgatctggcgca

SEQ ID NO: 740010 - DNA, 25 bp, Artificial sequence
  Synthetic oligonucleotide
attaggatggaagtcgacgaggctc

SEQ ID NO: 740011 - DNA, 25 bp, Artificial sequence
  Synthetic oligonucleotide
cagagttgggtttgcgggtcttcgg

SEQ ID NO: 740012 - DNA, 25 bp, Artificial sequence
  Synthetic oligonucleotide
cacggcaacaggcagagttgggttt

SEQ ID NO: 740013 - DNA, 25 bp, Artificial sequence
  Synthetic oligonucleotide
tgaagcgccactttggtggccacgg

SEQ ID NO: 740014 - DNA, 25 bp, Artificial sequence
  Synthetic oligonucleotide
acttgaagcgccactttggtggcca

SEQ ID NO: 740015 - DNA, 25 bp, Artificial sequence
  Synthetic oligonucleotide
ctctgacttgaagcgccactttggt

SEQ ID NO: 740016 - DNA, 25 bp, Artificial sequence
  Synthetic oligonucleotide
ctctctgacttgaagcgccactttg

SEQ ID NO: 740017 - DNA, 25 bp, Artificial sequence
  Synthetic oligonucleotide
tttcccagtttccaacgattcgatc

SEQ ID NO: 740018 - DNA, 25 bp, Artificial sequence
  Synthetic oligonucleotide
ggtgccgagctctctgacttgaagc

SEQ ID NO: 740019 - DNA, 25 bp, Artificial sequence
  Synthetic oligonucleotide
ctccgagagaagcagtgtgtgcatt

SEQ ID NO: 740020 - DNA, 25 bp, Artificial sequence
  Synthetic oligonucleotide
ccgagctctctgacttgaagcgcca

SEQ ID NO: 740021 - DNA, 25 bp, Artificial sequence
  Synthetic oligonucleotide
caagttcattatcgcctcgccaaag

SEQ ID NO: 740022 - DNA, 25 bp, Artificial sequence
  Synthetic oligonucleotide
tcacgcacggatgcctccgttaacg

SEQ ID NO: 740023 - DNA, 25 bp, Artificial sequence
  Synthetic oligonucleotide
ttagactcacgcacggatgcctccg

SEQ ID NO: 740024 - DNA, 25 bp, Artificial sequence
  Synthetic oligonucleotide
tgggttagactcacgcacggatgcc

SEQ ID NO: 740025 - DNA, 25 bp, Artificial sequence
  Synthetic oligonucleotide
gaaatgggttagactcacgcacgga

SEQ ID NO: 740026 - DNA, 25 bp, Artificial sequence
  Synthetic oligonucleotide
cggcagtgtgaaatgggttagactc

SEQ ID NO: 740027 - DNA, 25 bp, Artificial sequence
  Synthetic oligonucleotide
catgacggcagtgtgaaatgggtta

SEQ ID NO: 740028 - DNA, 25 bp, Artificial sequence
  Synthetic oligonucleotide
cgccaaagcatgacggcagtgtgaa

SEQ ID NO: 740029 - DNA, 25 bp, Artificial sequence
  Synthetic oligonucleotide
ctcgccaaagcatgacggcagtgtg

SEQ ID NO: 740030 - DNA, 25 bp, Artificial sequence
  Synthetic oligonucleotide
gcggcgctctgctccgagagaagca

SEQ ID NO: 740031 - DNA, 25 bp, Artificial sequence
  Synthetic oligonucleotide
ttcattatcgcctcgccaaagcatg

SEQ ID NO: 740032 - DNA, 25 bp, Artificial sequence
  Synthetic oligonucleotide
tcccagtttccaacgattcgatcgc

SEQ ID NO: 740033 - DNA, 25 bp, Artificial sequence
  Synthetic oligonucleotide
tgcaagttcattatcgcctcgccaa

SEQ ID NO: 740034 - DNA, 25 bp, Artificial sequence
  Synthetic oligonucleotide
ctcctgcaagttcattatcgcctcg

SEQ ID NO: 740035 - DNA, 25 bp, Artificial sequence
  Synthetic oligonucleotide
atttcctcctgcaagttcattatcg

SEQ ID NO: 740036 - DNA, 25 bp, Artificial sequence
  Synthetic oligonucleotide
ttcgatcgcccaacagcaagagagg

SEQ ID NO: 740037 - DNA, 25 bp, Artificial sequence
  Synthetic oligonucleotide
cagtttccaacgattcgatcgccca

SEQ ID NO: 740038 - DNA, 25 bp, Artificial sequence
  Synthetic oligonucleotide
ttccaacgattcgatcgcccaacag

SEQ ID NO: 740039 - DNA, 25 bp, Artificial sequence
  Synthetic oligonucleotide
ttatcgcctcgccaaagcatgacgg

SEQ ID NO: 740040 - DNA, 25 bp, Artificial sequence
  Synthetic oligonucleotide
gattcgatcgcccaacagcaagaga

SEQ ID NO: 740041 - DNA, 25 bp, Artificial sequence
  Synthetic oligonucleotide
tgcatttcctcctgcaagttcatta

SEQ ID NO: 740042 - DNA, 25 bp, Artificial sequence
  Synthetic oligonucleotide
tcgcccaacagcaagagaggcaaga

SEQ ID NO: 740043 - DNA, 25 bp, Artificial sequence
  Synthetic oligonucleotide
ccaacagcaagagaggcaagacggc

SEQ ID NO: 740044 - DNA, 25 bp, Artificial sequence
  Synthetic oligonucleotide
aagagaggcaagacggcggcgctct

SEQ ID NO: 740045 - DNA, 25 bp, Artificial sequence
  Synthetic oligonucleotide
gctctgctccgagagaagcagtgtg

SEQ ID NO: 740046 - DNA, 25 bp, Artificial sequence
  Synthetic oligonucleotide
gactcacgcacggatgcctccgtta

SEQ ID NO: 740047 - DNA, 25 bp, Artificial sequence
  Synthetic oligonucleotide
agagaagcagtgtgtgcatttcctc

SEQ ID NO: 740048 - DNA, 25 bp, Artificial sequence
  Synthetic oligonucleotide
gaagcagtgtgtgcatttcctcctg

SEQ ID NO: 740049 - DNA, 25 bp, Artificial sequence
  Synthetic oligonucleotide
agtgtgtgcatttcctcctgcaagt

SEQ ID NO: 740050 - DNA, 25 bp, Artificial sequence
  Synthetic oligonucleotide
gtgtgcatttcctcctgcaagttca

SEQ ID NO: 740051 - DNA, 25 bp, Artificial sequence
  Synthetic oligonucleotide
gttttcctgcctgaacacagtcatg

SEQ ID NO: 740052 - DNA, 25 bp, Artificial sequence
  Synthetic oligonucleotide
tggagagaagaatgaaacggtaaac

SEQ ID NO: 740053 - DNA, 25 bp, Artificial sequence
  Synthetic oligonucleotide
cagacctctgaaagacatggagaga

SEQ ID NO: 740054 - DNA, 25 bp, Artificial sequence
  Synthetic oligonucleotide
gccgcagacctctgaaagacatgga

SEQ ID NO: 740055 - DNA, 25 bp, Artificial sequence
  Synthetic oligonucleotide
tgcaccaagccgcagacctctgaaa

SEQ ID NO: 740056 - DNA, 25 bp, Artificial sequence
  Synthetic oligonucleotide
aagcccaggccactccggctccgcg

SEQ ID NO: 740057 - DNA, 25 bp, Artificial sequence
  Synthetic oligonucleotide
tgtcacgcctcaccaaagcccaggc

SEQ ID NO: 740058 - DNA, 25 bp, Artificial sequence
  Synthetic oligonucleotide
gatagactgtcacgcctcaccaaag

SEQ ID NO: 740059 - DNA, 25 bp, Artificial sequence
  Synthetic oligonucleotide
tcggtcctgatctcgaggcctccag

SEQ ID NO: 740060 - DNA, 25 bp, Artificial sequence
  Synthetic oligonucleotide
cctgcctgaacacagtcatgataga

SEQ ID NO: 740061 - DNA, 25 bp, Artificial sequence
  Synthetic oligonucleotide
tgatctcgaggcctccagcgggctg

SEQ ID NO: 740062 - DNA, 25 bp, Artificial sequence
  Synthetic oligonucleotide
gtccacgttttcctgcctgaacaca

SEQ ID NO: 740063 - DNA, 25 bp, Artificial sequence
  Synthetic oligonucleotide
agtcgtccacgttttcctgcctgaa

SEQ ID NO: 740064 - DNA, 25 bp, Artificial sequence
  Synthetic oligonucleotide
cgtagtagtcgtccacgttttcctg

SEQ ID NO: 740065 - DNA, 25 bp, Artificial sequence
  Synthetic oligonucleotide
tgtcgtagtagtcgtccacgttttc

SEQ ID NO: 740066 - DNA, 25 bp, Artificial sequence
  Synthetic oligonucleotide
ccggtgtcgtagtagtcgtccacgt

SEQ ID NO: 740067 - DNA, 25 bp, Artificial sequence
  Synthetic oligonucleotide
agttcctcgccggtgtcgtagtagt

SEQ ID NO: 740068 - DNA, 25 bp, Artificial sequence
  Synthetic oligonucleotide
cttcctggtacctgcccagttcctc

SEQ ID NO: 740069 - DNA, 25 bp, Artificial sequence
  Synthetic oligonucleotide
agtcatgatagactgtcacgcctca

SEQ ID NO: 740070 - DNA, 25 bp, Artificial sequence
  Synthetic oligonucleotide
acagccaccacctcttcagcgccct

SEQ ID NO: 740071 - DNA, 25 bp, Artificial sequence
  Synthetic oligonucleotide
gagtgtgaacccaaggatccgtgtg

SEQ ID NO: 740072 - DNA, 25 bp, Artificial sequence
  Synthetic oligonucleotide
cccaaggatccgtgtgggccagacg

SEQ ID NO: 740073 - DNA, 25 bp, Artificial sequence
  Synthetic oligonucleotide
ccgtgtgggccagacgacgtgcttc

SEQ ID NO: 740074 - DNA, 25 bp, Artificial sequence
  Synthetic oligonucleotide
cggaggctttcgtcccccagagtgt

SEQ ID NO: 740075 - DNA, 25 bp, Artificial sequence
  Synthetic oligonucleotide
tcgaagaagccggaggctttcgtcc

SEQ ID NO: 740076 - DNA, 25 bp, Artificial sequence
  Synthetic oligonucleotide
cgcttcgaagaagccggaggctttc

SEQ ID NO: 740077 - DNA, 25 bp, Artificial sequence
  Synthetic oligonucleotide
tgccgcccgcttcgaagaagccgga

SEQ ID NO: 740078 - DNA, 25 bp, Artificial sequence
  Synthetic oligonucleotide
cccgcacacacccactcgcccgcac

SEQ ID NO: 740079 - DNA, 25 bp, Artificial sequence
  Synthetic oligonucleotide
cccgggctcggtcctgatctcgagg

SEQ ID NO: 740080 - DNA, 25 bp, Artificial sequence
  Synthetic oligonucleotide
ctcagggaagggacacaaagcgcct

SEQ ID NO: 740081 - DNA, 25 bp, Artificial sequence
  Synthetic oligonucleotide
cccagagtgtgaacccaaggatccg

SEQ ID NO: 740082 - DNA, 25 bp, Artificial sequence
  Synthetic oligonucleotide
tccgctccgtgagtcgggcgcagct

SEQ ID NO: 740083 - DNA, 25 bp, Artificial sequence
  Synthetic oligonucleotide
tccgagtggcctccgctccgtgagt

SEQ ID NO: 740084 - DNA, 25 bp, Artificial sequence
  Synthetic oligonucleotide
gcacctctcgctccgagcgccctga

SEQ ID NO: 740085 - DNA, 25 bp, Artificial sequence
  Synthetic oligonucleotide
tcctcccactgcctgcggcggccac

SEQ ID NO: 740086 - DNA, 25 bp, Artificial sequence
  Synthetic oligonucleotide
aagggacacaaagcgcctggcccgg

SEQ ID NO: 740087 - DNA, 25 bp, Artificial sequence
  Synthetic oligonucleotide
cctccggacgactccgggacagctc

SEQ ID NO: 740088 - DNA, 25 bp, Artificial sequence
  Synthetic oligonucleotide
gcgccctttgttaagtctgggctgg

SEQ ID NO: 740089 - DNA, 25 bp, Artificial sequence
  Synthetic oligonucleotide
gaccacgcgccctttgttaagtctg

SEQ ID NO: 740090 - DNA, 25 bp, Artificial sequence
  Synthetic oligonucleotide
cggctcctcccggtccgcgctcccg

SEQ ID NO: 740091 - DNA, 25 bp, Artificial sequence
  Synthetic oligonucleotide
agcagggtccctgtttgagacggac

SEQ ID NO: 740092 - DNA, 25 bp, Artificial sequence
  Synthetic oligonucleotide
gggacagaaggagcgcggacgaccc

SEQ ID NO: 740093 - DNA, 25 bp, Artificial sequence
  Synthetic oligonucleotide
aagaaagttgggctccagagggcca

SEQ ID NO: 740094 - DNA, 25 bp, Artificial sequence
  Synthetic oligonucleotide
caggtatgtggagggtcccacgacc

SEQ ID NO: 740095 - DNA, 25 bp, Artificial sequence
  Synthetic oligonucleotide
tatgtggagggtcccacgacccgct

SEQ ID NO: 740096 - DNA, 25 bp, Artificial sequence
  Synthetic oligonucleotide
tgtggagggtcccacgacccgcttc

SEQ ID NO: 740097 - DNA, 25 bp, Artificial sequence
  Synthetic oligonucleotide
cacgacccgcttcgctttttcgctt

SEQ ID NO: 740098 - DNA, 25 bp, Artificial sequence
  Synthetic oligonucleotide
tttttgccttctgtggttccacttc

SEQ ID NO: 740099 - DNA, 25 bp, Artificial sequence
  Synthetic oligonucleotide
tgccttctgtggttccacttccctt

SEQ ID NO: 740100 - DNA, 25 bp, Artificial sequence
  Synthetic oligonucleotide
cccgagttgagcagggtccctgttt

SEQ ID NO: 740101 - DNA, 25 bp, Artificial sequence
  Synthetic oligonucleotide
tccctgtttgagacggacggaggag

SEQ ID NO: 740102 - DNA, 25 bp, Artificial sequence
  Synthetic oligonucleotide
ctcagtgtttgctcggcgtttgccc

SEQ ID NO: 740103 - DNA, 25 bp, Artificial sequence
  Synthetic oligonucleotide
gccagatcgccctggaggctacgct

SEQ ID NO: 740104 - DNA, 25 bp, Artificial sequence
  Synthetic oligonucleotide
cagatcgccctggaggctacgctgt

SEQ ID NO: 740105 - DNA, 25 bp, Artificial sequence
  Synthetic oligonucleotide
tcgccctggaggctacgctgtgcag

SEQ ID NO: 740106 - DNA, 25 bp, Artificial sequence
  Synthetic oligonucleotide
cagaggggccgcctctcgcttaggt

SEQ ID NO: 740107 - DNA, 25 bp, Artificial sequence
  Synthetic oligonucleotide
cgcctctcgcttaggttcccaggtg

SEQ ID NO: 740108 - DNA, 25 bp, Artificial sequence
  Synthetic oligonucleotide
cctctcgcttaggttcccaggtggg

SEQ ID NO: 740109 - DNA, 25 bp, Artificial sequence
  Synthetic oligonucleotide
cgccacgctgccgtctcccgggacc

SEQ ID NO: 740110 - DNA, 25 bp, Artificial sequence
  Synthetic oligonucleotide
cttcttccaagaaagttgggctcca

SEQ ID NO: 740111 - DNA, 25 bp, Artificial sequence
  Synthetic oligonucleotide
ttctgctagacttcagcccggccta

SEQ ID NO: 740112 - DNA, 25 bp, Artificial sequence
  Synthetic oligonucleotide
gacggaggaggcgtgtattaggatg

SEQ ID NO: 740113 - DNA, 25 bp, Artificial sequence
  Synthetic oligonucleotide
ctctgcttggctcactggtgtggga

SEQ ID NO: 740114 - DNA, 25 bp, Artificial sequence
  Synthetic oligonucleotide
ccgcggcgcactactgagttctcaa

SEQ ID NO: 740115 - DNA, 25 bp, Artificial sequence
  Synthetic oligonucleotide
gcggcgcactactgagttctcaaga

SEQ ID NO: 740116 - DNA, 25 bp, Artificial sequence
  Synthetic oligonucleotide
ggcgcactactgagttctcaagaac

SEQ ID NO: 740117 - DNA, 25 bp, Artificial sequence
  Synthetic oligonucleotide
gcactactgagttctcaagaacttc

SEQ ID NO: 740118 - DNA, 25 bp, Artificial sequence
  Synthetic oligonucleotide
tgagttctcaagaacttctgctaga

SEQ ID NO: 740119 - DNA, 25 bp, Artificial sequence
  Synthetic oligonucleotide
ctgctcctgctgcaggtatgtggag

SEQ ID NO: 740120 - DNA, 25 bp, Artificial sequence
  Synthetic oligonucleotide
agaacttctgctagacttcagcccg

SEQ ID NO: 740121 - DNA, 25 bp, Artificial sequence
  Synthetic oligonucleotide
atgggagcccggtgccgcagcttct

SEQ ID NO: 740122 - DNA, 25 bp, Artificial sequence
  Synthetic oligonucleotide
tctgctagacttcagcccggcctaa

SEQ ID NO: 740123 - DNA, 25 bp, Artificial sequence
  Synthetic oligonucleotide
tcagcccggcctaacccggccctgc

SEQ ID NO: 740124 - DNA, 25 bp, Artificial sequence
  Synthetic oligonucleotide
cgaccgcacccgagctcagtgtttg

SEQ ID NO: 740125 - DNA, 25 bp, Artificial sequence
  Synthetic oligonucleotide
accgcacccgagctcagtgtttgct

SEQ ID NO: 740126 - DNA, 25 bp, Artificial sequence
  Synthetic oligonucleotide
cgcacccgagctcagtgtttgctcg

SEQ ID NO: 740127 - DNA, 25 bp, Artificial sequence
  Synthetic oligonucleotide
agctcagtgtttgctcggcgtttgc

SEQ ID NO: 740128 - DNA, 25 bp, Artificial sequence
  Synthetic oligonucleotide
ctccagagggccagatcgccctgga

SEQ ID NO: 740129 - DNA, 25 bp, Artificial sequence
  Synthetic oligonucleotide
tcaagaacttctgctagacttcagc

SEQ ID NO: 740130 - DNA, 25 bp, Artificial sequence
  Synthetic oligonucleotide
ttccaagaaagttgggctccagagg

SEQ ID NO: 740131 - DNA, 25 bp, Artificial sequence
  Synthetic oligonucleotide
ctggcttaatactctccgttccacg

SEQ ID NO: 740132 - DNA, 25 bp, Artificial sequence
  Synthetic oligonucleotide
gctggcttaatactctccgttccac

SEQ ID NO: 740133 - DNA, 25 bp, Artificial sequence
  Synthetic oligonucleotide
ggctggcttaatactctccgttcca

SEQ ID NO: 740134 - DNA, 25 bp, Artificial sequence
  Synthetic oligonucleotide
aggctggcttaatactctccgttcc

SEQ ID NO: 740135 - DNA, 25 bp, Artificial sequence
  Synthetic oligonucleotide
caggctggcttaatactctccgttc

SEQ ID NO: 740136 - DNA, 25 bp, Artificial sequence
  Synthetic oligonucleotide
ccaggctggcttaatactctccgtt

SEQ ID NO: 740137 - DNA, 25 bp, Artificial sequence
  Synthetic oligonucleotide
accaggctggcttaatactctccgt

SEQ ID NO: 740138 - DNA, 25 bp, Artificial sequence
  Synthetic oligonucleotide
gcaaccctctgcaacctggctctgc

SEQ ID NO: 740139 - DNA, 25 bp, Artificial sequence
  Synthetic oligonucleotide
tggcttaatactctccgttccacga

SEQ ID NO: 740140 - DNA, 25 bp, Artificial sequence
  Synthetic oligonucleotide
cgcgtaccaggctggcttaatactc

SEQ ID NO: 740141 - DNA, 25 bp, Artificial sequence
  Synthetic oligonucleotide
taccaggctggcttaatactctccg

SEQ ID NO: 740142 - DNA, 25 bp, Artificial sequence
  Synthetic oligonucleotide
ccgcgtaccaggctggcttaatact

SEQ ID NO: 740143 - DNA, 25 bp, Artificial sequence
  Synthetic oligonucleotide
ctccgcgtaccaggctggcttaata

SEQ ID NO: 740144 - DNA, 25 bp, Artificial sequence
  Synthetic oligonucleotide
cctccgcgtaccaggctggcttaat

SEQ ID NO: 740145 - DNA, 25 bp, Artificial sequence
  Synthetic oligonucleotide
gcctccgcgtaccaggctggcttaa

SEQ ID NO: 740146 - DNA, 25 bp, Artificial sequence
  Synthetic oligonucleotide
cgtgctcggcccacagaaagccctc

SEQ ID NO: 740147 - DNA, 25 bp, Artificial sequence
  Synthetic oligonucleotide
gcgtgctcggcccacagaaagccct

SEQ ID NO: 740148 - DNA, 25 bp, Artificial sequence
  Synthetic oligonucleotide
cgcccccatcacgtgcaccagcctg

SEQ ID NO: 740149 - DNA, 25 bp, Artificial sequence
  Synthetic oligonucleotide
tcacgcactaggcgtgctcggccca

SEQ ID NO: 740150 - DNA, 25 bp, Artificial sequence
  Synthetic oligonucleotide
gtaccaggctggcttaatactctcc

SEQ ID NO: 740151 - DNA, 25 bp, Artificial sequence
  Synthetic oligonucleotide
ctcacagctccgcaaccctctgcaa

SEQ ID NO: 740152 - DNA, 25 bp, Artificial sequence
  Synthetic oligonucleotide
cctctgcaacctggctctgcccctg

SEQ ID NO: 740153 - DNA, 25 bp, Artificial sequence
  Synthetic oligonucleotide
gcgtaccaggctggcttaatactct

SEQ ID NO: 740154 - DNA, 25 bp, Artificial sequence
  Synthetic oligonucleotide
ggcttaatactctccgttccacgat

SEQ ID NO: 740155 - DNA, 25 bp, Artificial sequence
  Synthetic oligonucleotide
aaccctctgcaacctggctctgccc

SEQ ID NO: 740156 - DNA, 25 bp, Artificial sequence
  Synthetic oligonucleotide
cgcaaccctctgcaacctggctctg

SEQ ID NO: 740157 - DNA, 25 bp, Artificial sequence
  Synthetic oligonucleotide
tccgcaaccctctgcaacctggctc

SEQ ID NO: 740158 - DNA, 25 bp, Artificial sequence
  Synthetic oligonucleotide
agctccgcaaccctctgcaacctgg

SEQ ID NO: 740159 - DNA, 25 bp, Artificial sequence
  Synthetic oligonucleotide
gatctcacagctccgcaaccctctg

SEQ ID NO: 740160 - DNA, 25 bp, Artificial sequence
  Synthetic oligonucleotide
tccacgatctcacagctccgcaacc

SEQ ID NO: 740161 - DNA, 25 bp, Artificial sequence
  Synthetic oligonucleotide
atactctccgttccacgatctcaca

SEQ ID NO: 740162 - DNA, 25 bp, Artificial sequence
  Synthetic oligonucleotide
gcttaatactctccgttccacgatc

SEQ ID NO: 740163 - DNA, 25 bp, Artificial sequence
  Synthetic oligonucleotide
ttaatactctccgttccacgatctc

SEQ ID NO: 740164 - DNA, 25 bp, Artificial sequence
  Synthetic oligonucleotide
gctccgcaaccctctgcaacctggc

SEQ ID NO: 740165 - DNA, 25 bp, Artificial sequence
  Synthetic oligonucleotide
taatactctccgttccacgatctca

SEQ ID NO: 740166 - DNA, 25 bp, Artificial sequence
  Synthetic oligonucleotide
gttccacgatctcacagctccgcaa

SEQ ID NO: 740167 - DNA, 25 bp, Artificial sequence
  Synthetic oligonucleotide
actctccgttccacgatctcacagc

SEQ ID NO: 740168 - DNA, 25 bp, Artificial sequence
  Synthetic oligonucleotide
tctccgttccacgatctcacagctc

SEQ ID NO: 740169 - DNA, 25 bp, Artificial sequence
  Synthetic oligonucleotide
tccgttccacgatctcacagctccg

SEQ ID NO: 740170 - DNA, 25 bp, Artificial sequence
  Synthetic oligonucleotide
cgttccacgatctcacagctccgca

SEQ ID NO: 740171 - DNA, 25 bp, Artificial sequence
  Synthetic oligonucleotide
ctcagacgcagacgaataaaggccc

SEQ ID NO: 740172 - DNA, 25 bp, Artificial sequence
  Synthetic oligonucleotide
ctgagtcaacacagtggagggaatc

SEQ ID NO: 740173 - DNA, 25 bp, Artificial sequence
  Synthetic oligonucleotide
gctgcgtggacgatgaagtatctca

SEQ ID NO: 740174 - DNA, 25 bp, Artificial sequence
  Synthetic oligonucleotide
gacgatgaagtatctcagacgcaga

SEQ ID NO: 740175 - DNA, 25 bp, Artificial sequence
  Synthetic oligonucleotide
gatgaagtatctcagacgcagacga

SEQ ID NO: 740176 - DNA, 25 bp, Artificial sequence
  Synthetic oligonucleotide
gaagtatctcagacgcagacgaata

SEQ ID NO: 740177 - DNA, 25 bp, Artificial sequence
  Synthetic oligonucleotide
aatcgggtagcggagctcggcaact

SEQ ID NO: 740178 - DNA, 25 bp, Artificial sequence
  Synthetic oligonucleotide
tatctcagacgcagacgaataaagg

SEQ ID NO: 740179 - DNA, 25 bp, Artificial sequence
  Synthetic oligonucleotide
gtggacgatgaagtatctcagacgc

SEQ ID NO: 740180 - DNA, 25 bp, Artificial sequence
  Synthetic oligonucleotide
cgcagacgaataaaggccccagagc

SEQ ID NO: 740181 - DNA, 25 bp, Artificial sequence
  Synthetic oligonucleotide
ccagagccgccagccttataagggg

SEQ ID NO: 740182 - DNA, 25 bp, Artificial sequence
  Synthetic oligonucleotide
agagccgccagccttataaggggca

SEQ ID NO: 740183 - DNA, 25 bp, Artificial sequence
  Synthetic oligonucleotide
agccgccagccttataaggggcatt

SEQ ID NO: 740184 - DNA, 25 bp, Artificial sequence
  Synthetic oligonucleotide
ccgccagccttataaggggcattgc

SEQ ID NO: 740185 - DNA, 25 bp, Artificial sequence
  Synthetic oligonucleotide
ccagccttataaggggcattgcgcc

SEQ ID NO: 740186 - DNA, 25 bp, Artificial sequence
  Synthetic oligonucleotide
ttataaggggcattgcgccccgccc

SEQ ID NO: 740187 - DNA, 25 bp, Artificial sequence
  Synthetic oligonucleotide
cggatgctgagtcaacacagtggag

SEQ ID NO: 740188 - DNA, 25 bp, Artificial sequence
  Synthetic oligonucleotide
tcaacacagtggagggaatcgggta

SEQ ID NO: 740189 - DNA, 25 bp, Artificial sequence
  Synthetic oligonucleotide
aaagctgcgtggacgatgaagtatc

SEQ ID NO: 740190 - DNA, 25 bp, Artificial sequence
  Synthetic oligonucleotide
cccggatgctgagtcaacacagtgg

SEQ ID NO: 740191 - DNA, 25 bp, Artificial sequence
  Synthetic oligonucleotide
cgggtagcggagctcggcaactccc

SEQ ID NO: 740192 - DNA, 25 bp, Artificial sequence
  Synthetic oligonucleotide
tcaaagctgcgtggacgatgaagta

SEQ ID NO: 740193 - DNA, 25 bp, Artificial sequence
  Synthetic oligonucleotide
tgcgtggacgatgaagtatctcaga

SEQ ID NO: 740194 - DNA, 25 bp, Artificial sequence
  Synthetic oligonucleotide
agctcggcaactcccggctcctgcc

SEQ ID NO: 740195 - DNA, 25 bp, Artificial sequence
  Synthetic oligonucleotide
gctgggcggcgcgaacttactagct

SEQ ID NO: 740196 - DNA, 25 bp, Artificial sequence
  Synthetic oligonucleotide
gggcggcgcgaacttactagctgct

SEQ ID NO: 740197 - DNA, 25 bp, Artificial sequence
  Synthetic oligonucleotide
cggcgcgaacttactagctgctgcg

SEQ ID NO: 740198 - DNA, 25 bp, Artificial sequence
  Synthetic oligonucleotide
gcgcgaacttactagctgctgcgta

SEQ ID NO: 740199 - DNA, 25 bp, Artificial sequence
  Synthetic oligonucleotide
gcgaacttactagctgctgcgtaga

SEQ ID NO: 740200 - DNA, 25 bp, Artificial sequence
  Synthetic oligonucleotide
gaacttactagctgctgcgtagaca

SEQ ID NO: 740201 - DNA, 25 bp, Artificial sequence
  Synthetic oligonucleotide
tgtggactcaaagctgcgtggacga

SEQ ID NO: 740202 - DNA, 25 bp, Artificial sequence
  Synthetic oligonucleotide
tggactcaaagctgcgtggacgatg

SEQ ID NO: 740203 - DNA, 25 bp, Artificial sequence
  Synthetic oligonucleotide
ttactagctgctgcgtagacagagg

SEQ ID NO: 740204 - DNA, 25 bp, Artificial sequence
  Synthetic oligonucleotide
ctagctgctgcgtagacagaggtgt

SEQ ID NO: 740205 - DNA, 25 bp, Artificial sequence
  Synthetic oligonucleotide
ctgcgtagacagaggtgtggactca

SEQ ID NO: 740206 - DNA, 25 bp, Artificial sequence
  Synthetic oligonucleotide
gcgtagacagaggtgtggactcaaa

SEQ ID NO: 740207 - DNA, 25 bp, Artificial sequence
  Synthetic oligonucleotide
gacagaggtgtggactcaaagctgc

SEQ ID NO: 740208 - DNA, 25 bp, Artificial sequence
  Synthetic oligonucleotide
cagaggtgtggactcaaagctgcgt

SEQ ID NO: 740209 - DNA, 25 bp, Artificial sequence
  Synthetic oligonucleotide
ggactcaaagctgcgtggacgatga

SEQ ID NO: 740210 - DNA, 25 bp, Artificial sequence
  Synthetic oligonucleotide
acttactagctgctgcgtagacaga

SEQ ID NO: 740211 - DNA, 25 bp, Artificial sequence
  Synthetic oligonucleotide
tgtagctgatgatccgaataactac

SEQ ID NO: 740212 - DNA, 25 bp, Artificial sequence
  Synthetic oligonucleotide
tgtagctgatgaaccgaataactac

SEQ ID NO: 740213 - DNA, 25 bp, Artificial sequence
  Synthetic oligonucleotide
accagccagctatcaactcgcgccc

SEQ ID NO: 740214 - DNA, 25 bp, Artificial sequence
  Synthetic oligonucleotide
accagccagctaacaactcgcgccc

SEQ ID NO: 740215 - DNA, 25 bp, Artificial sequence
  Synthetic oligonucleotide
gcaactcatcgattgatttacggcg

SEQ ID NO: 740216 - DNA, 25 bp, Artificial sequence
  Synthetic oligonucleotide
gattgatttacggcgctaaggatga

SEQ ID NO: 740217 - DNA, 25 bp, Artificial sequence
  Synthetic oligonucleotide
tggtcgagcgatcgatttccgtctc

SEQ ID NO: 740218 - DNA, 25 bp, Artificial sequence
  Synthetic oligonucleotide
gattgatttacgccgctaaggatga

SEQ ID NO: 740219 - DNA, 25 bp, Artificial sequence
  Synthetic oligonucleotide
gcaactcatcgaatgatttacggcg

SEQ ID NO: 740220 - DNA, 25 bp, Artificial sequence
  Synthetic oligonucleotide
gtctctggtgtacctgatgatccga

SEQ ID NO: 740221 - DNA, 25 bp, Artificial sequence
  Synthetic oligonucleotide
gtctctggtgtagctgatgatccga

SEQ ID NO: 740222 - DNA, 25 bp, Artificial sequence
  Synthetic oligonucleotide
caccgcaggtgttgagaaggcactt

SEQ ID NO: 740223 - DNA, 25 bp, Artificial sequence
  Synthetic oligonucleotide
atggatttccgtctctggtgtagct

SEQ ID NO: 740224 - DNA, 25 bp, Artificial sequence
  Synthetic oligonucleotide
tggtcgagcgatggatttccgtctc

SEQ ID NO: 740225 - DNA, 25 bp, Artificial sequence
  Synthetic oligonucleotide
caccgcaggtgtagagaaggcactt

SEQ ID NO: 740226 - DNA, 25 bp, Artificial sequence
  Synthetic oligonucleotide
taaggatgactctggtcagagatac

SEQ ID NO: 740227 - DNA, 25 bp, Artificial sequence
  Synthetic oligonucleotide
ggagtttcaatagcggagatcatgc

SEQ ID NO: 740228 - DNA, 25 bp, Artificial sequence
  Synthetic oligonucleotide
cgctggttagcaccgcaggtgtaga

SEQ ID NO: 740229 - DNA, 25 bp, Artificial sequence
  Synthetic oligonucleotide
atggatttccgtgtctggtgtagct

SEQ ID NO: 740230 - DNA, 25 bp, Artificial sequence
  Synthetic oligonucleotide
ggagatcatgcaagctggtggctgg

SEQ ID NO: 740231 - DNA, 25 bp, Artificial sequence
  Synthetic oligonucleotide
tagtgaaacaggggcaatggtgcgc

SEQ ID NO: 740232 - DNA, 25 bp, Artificial sequence
  Synthetic oligonucleotide
ttgtcatgaactttatccgtaacct

SEQ ID NO: 740233 - DNA, 25 bp, Artificial sequence
  Synthetic oligonucleotide
tagtgaaacaggcgcaatggtgcgc

SEQ ID NO: 740234 - DNA, 25 bp, Artificial sequence
  Synthetic oligonucleotide
ttgtcatgaactatatccgtaacct

SEQ ID NO: 740235 - DNA, 25 bp, Artificial sequence
  Synthetic oligonucleotide
ccaatgtaaataatgtcatgaacta

SEQ ID NO: 740236 - DNA, 25 bp, Artificial sequence
  Synthetic oligonucleotide
ccaatgtaaatattgtcatgaacta

SEQ ID NO: 740237 - DNA, 25 bp, Artificial sequence
  Synthetic oligonucleotide
ctggtggctggagcaatgtaaatat

SEQ ID NO: 740238 - DNA, 25 bp, Artificial sequence
  Synthetic oligonucleotide
ctggtggctggaccaatgtaaatat

SEQ ID NO: 740239 - DNA, 25 bp, Artificial sequence
  Synthetic oligonucleotide
cgagatatggccggcgctggagttt

SEQ ID NO: 740240 - DNA, 25 bp, Artificial sequence
  Synthetic oligonucleotide
ggagatcatgcatgctggtggctgg

SEQ ID NO: 740241 - DNA, 25 bp, Artificial sequence
  Synthetic oligonucleotide
taaggatgactcaggtcagagatac

SEQ ID NO: 740242 - DNA, 25 bp, Artificial sequence
  Synthetic oligonucleotide
ggagtttcaataccggagatcatgc

SEQ ID NO: 740243 - DNA, 25 bp, Artificial sequence
  Synthetic oligonucleotide
cgctggttagcagcgcaggtgtaga

SEQ ID NO: 740244 - DNA, 25 bp, Artificial sequence
  Synthetic oligonucleotide
cgagatatggcccgcgctggagttt

SEQ ID NO: 740245 - DNA, 25 bp, Artificial sequence
  Synthetic oligonucleotide
gtgcccgtgtcgcagccgcgcgaga

SEQ ID NO: 740246 - DNA, 25 bp, Artificial sequence
  Synthetic oligonucleotide
gtgcccgtgtcggagccgcgcgaga

SEQ ID NO: 740247 - DNA, 25 bp, Artificial sequence
  Synthetic oligonucleotide
ctggtctggacagagtgcccgtgtc

SEQ ID NO: 740248 - DNA, 25 bp, Artificial sequence
  Synthetic oligonucleotide
ctggtctggacacagtgcccgtgtc

SEQ ID NO: 740249 - DNA, 25 bp, Artificial sequence
  Synthetic oligonucleotide
tggtcagagatagctggcctggtct

SEQ ID NO: 740250 - DNA, 25 bp, Artificial sequence
  Synthetic oligonucleotide
tggtcagagatacctggcctggtct

SEQ ID NO: 740251 - DNA, 25 bp, Artificial sequence
  Synthetic oligonucleotide
cgagatatggccggcgctggagttt

SEQ ID NO: 740252 - DNA, 25 bp, Artificial sequence
  Synthetic oligonucleotide
atggatttccgtgtctggtgtagct

SEQ ID NO: 740253 - DNA, 25 bp, Artificial sequence
  Synthetic oligonucleotide
ggagtttcaatagcggagatcatgc

SEQ ID NO: 740254 - DNA, 25 bp, Artificial sequence
  Synthetic oligonucleotide
gcaactcatcgaatgatttacggcg

SEQ ID NO: 740255 - DNA, 25 bp, Artificial sequence
  Synthetic oligonucleotide
gcaactcatcgattgatttacggcg

SEQ ID NO: 740256 - DNA, 25 bp, Artificial sequence
  Synthetic oligonucleotide
accagccagctaacaactcgcgccc

SEQ ID NO: 740257 - DNA, 25 bp, Artificial sequence
  Synthetic oligonucleotide
accagccagctatcaactcgcgccc

SEQ ID NO: 740258 - DNA, 25 bp, Artificial sequence
  Synthetic oligonucleotide
tgtagctgatgaaccgaataactac

SEQ ID NO: 740259 - DNA, 25 bp, Artificial sequence
  Synthetic oligonucleotide
tgtagctgatgatccgaataactac

SEQ ID NO: 740260 - DNA, 25 bp, Artificial sequence
  Synthetic oligonucleotide
gattgatttacgccgctaaggatga

SEQ ID NO: 740261 - DNA, 25 bp, Artificial sequence
  Synthetic oligonucleotide
gtctctggtgtagctgatgatccga

SEQ ID NO: 740262 - DNA, 25 bp, Artificial sequence
  Synthetic oligonucleotide
taaggatgactctggtcagagatac

SEQ ID NO: 740263 - DNA, 25 bp, Artificial sequence
  Synthetic oligonucleotide
atggatttccgtctctggtgtagct

SEQ ID NO: 740264 - DNA, 25 bp, Artificial sequence
  Synthetic oligonucleotide
tggtcgagcgatcgatttccgtctc

SEQ ID NO: 740265 - DNA, 25 bp, Artificial sequence
  Synthetic oligonucleotide
tggtcgagcgatggatttccgtctc

SEQ ID NO: 740266 - DNA, 25 bp, Artificial sequence
  Synthetic oligonucleotide
caccgcaggtgtagagaaggcactt

SEQ ID NO: 740267 - DNA, 25 bp, Artificial sequence
  Synthetic oligonucleotide
caccgcaggtgttgagaaggcactt

SEQ ID NO: 740268 - DNA, 25 bp, Artificial sequence
  Synthetic oligonucleotide
cgctggttagcaccgcaggtgtaga

SEQ ID NO: 740269 - DNA, 25 bp, Artificial sequence
  Synthetic oligonucleotide
cgctggttagcagcgcaggtgtaga

SEQ ID NO: 740270 - DNA, 25 bp, Artificial sequence
  Synthetic oligonucleotide
gtctctggtgtacctgatgatccga

SEQ ID NO: 740271 - DNA, 25 bp, Artificial sequence
  Synthetic oligonucleotide
ggagtttcaataccggagatcatgc

SEQ ID NO: 740272 - DNA, 25 bp, Artificial sequence
  Synthetic oligonucleotide
tagtgaaacaggggcaatggtgcgc

SEQ ID NO: 740273 - DNA, 25 bp, Artificial sequence
  Synthetic oligonucleotide
ttgtcatgaactttatccgtaacct

SEQ ID NO: 740274 - DNA, 25 bp, Artificial sequence
  Synthetic oligonucleotide
ttgtcatgaactatatccgtaacct

SEQ ID NO: 740275 - DNA, 25 bp, Artificial sequence
  Synthetic oligonucleotide
ccaatgtaaataatgtcatgaacta

SEQ ID NO: 740276 - DNA, 25 bp, Artificial sequence
  Synthetic oligonucleotide
ccaatgtaaatattgtcatgaacta

SEQ ID NO: 740277 - DNA, 25 bp, Artificial sequence
  Synthetic oligonucleotide
ctggtggctggagcaatgtaaatat

SEQ ID NO: 740278 - DNA, 25 bp, Artificial sequence
  Synthetic oligonucleotide
ctggtggctggaccaatgtaaatat

SEQ ID NO: 740279 - DNA, 25 bp, Artificial sequence
  Synthetic oligonucleotide
gattgatttacggcgctaaggatga

SEQ ID NO: 740280 - DNA, 25 bp, Artificial sequence
  Synthetic oligonucleotide
ggagatcatgcaagctggtggctgg

SEQ ID NO: 740281 - DNA, 25 bp, Artificial sequence
  Synthetic oligonucleotide
tagtgaaacaggcgcaatggtgcgc

SEQ ID NO: 740282 - DNA, 25 bp, Artificial sequence
  Synthetic oligonucleotide
cgagatatggcccgcgctggagttt

SEQ ID NO: 740283 - DNA, 25 bp, Artificial sequence
  Synthetic oligonucleotide
gtgcccgtgtcgcagccgcgcgaga

SEQ ID NO: 740284 - DNA, 25 bp, Artificial sequence
  Synthetic oligonucleotide
gtgcccgtgtcggagccgcgcgaga

SEQ ID NO: 740285 - DNA, 25 bp, Artificial sequence
  Synthetic oligonucleotide
ctggtctggacagagtgcccgtgtc

SEQ ID NO: 740286 - DNA, 25 bp, Artificial sequence
  Synthetic oligonucleotide
ctggtctggacacagtgcccgtgtc

SEQ ID NO: 740287 - DNA, 25 bp, Artificial sequence
  Synthetic oligonucleotide
tggtcagagatagctggcctggtct

SEQ ID NO: 740288 - DNA, 25 bp, Artificial sequence
  Synthetic oligonucleotide
tggtcagagatacctggcctggtct

SEQ ID NO: 740289 - DNA, 25 bp, Artificial sequence
  Synthetic oligonucleotide
taaggatgactcaggtcagagatac

SEQ ID NO: 740290 - DNA, 25 bp, Artificial sequence
  Synthetic oligonucleotide
ggagatcatgcatgctggtggctgg

SEQ ID NO: 740291 - DNA, 25 bp, Artificial sequence
  Synthetic oligonucleotide
gaccaagtgacaccaatgctgtttc

SEQ ID NO: 740292 - DNA, 25 bp, Artificial sequence
  Synthetic oligonucleotide
gacatgttcaggcatcgccaggcgt

SEQ ID NO: 740293 - DNA, 25 bp, Artificial sequence
  Synthetic oligonucleotide
atttgcctgcataaccggtcgatgc

SEQ ID NO: 740294 - DNA, 25 bp, Artificial sequence
  Synthetic oligonucleotide
tctatatcttcacgcgcgcggtctg

SEQ ID NO: 740295 - DNA, 25 bp, Artificial sequence
  Synthetic oligonucleotide
gaagatgttcgccattatcttctat

SEQ ID NO: 740296 - DNA, 25 bp, Artificial sequence
  Synthetic oligonucleotide
gaagatgttcgcgattatcttctat

SEQ ID NO: 740297 - DNA, 25 bp, Artificial sequence
  Synthetic oligonucleotide
gcggcatggtgctagttgaataacc

SEQ ID NO: 740298 - DNA, 25 bp, Artificial sequence
  Synthetic oligonucleotide
gcggcatggtgcaagttgaataacc

SEQ ID NO: 740299 - DNA, 25 bp, Artificial sequence
  Synthetic oligonucleotide
gccaggcgttttgtgagcatacctg

SEQ ID NO: 740300 - DNA, 25 bp, Artificial sequence
  Synthetic oligonucleotide
gcaacatttgggccagctaaacatg

SEQ ID NO: 740301 - DNA, 25 bp, Artificial sequence
  Synthetic oligonucleotide
gacatgttcagggatcgccaggcgt

SEQ ID NO: 740302 - DNA, 25 bp, Artificial sequence
  Synthetic oligonucleotide
gcaacatttggggcagctaaacatg

SEQ ID NO: 740303 - DNA, 25 bp, Artificial sequence
  Synthetic oligonucleotide
gcaagaacctgatggacatgttcag

SEQ ID NO: 740304 - DNA, 25 bp, Artificial sequence
  Synthetic oligonucleotide
gcaagaacctgaaggacatgttcag

SEQ ID NO: 740305 - DNA, 25 bp, Artificial sequence
  Synthetic oligonucleotide
gagtgatgaggttcgcaagaacctg

SEQ ID NO: 740306 - DNA, 25 bp, Artificial sequence
  Synthetic oligonucleotide
gagtgatgaggtacgcaagaacctg

SEQ ID NO: 740307 - DNA, 25 bp, Artificial sequence
  Synthetic oligonucleotide
taccggtcgatgcaacgagtgatga

SEQ ID NO: 740308 - DNA, 25 bp, Artificial sequence
  Synthetic oligonucleotide
taccggtcgatggaacgagtgatga

SEQ ID NO: 740309 - DNA, 25 bp, Artificial sequence
  Synthetic oligonucleotide
atttgcctgcattaccggtcgatgc

SEQ ID NO: 740310 - DNA, 25 bp, Artificial sequence
  Synthetic oligonucleotide
gccaggcgttttctgagcatacctg

SEQ ID NO: 740311 - DNA, 25 bp, Artificial sequence
  Synthetic oligonucleotide
acgtgcaaaacaggctctagcgttc

SEQ ID NO: 740312 - DNA, 25 bp, Artificial sequence
  Synthetic oligonucleotide
aatgctgtttcagtggttatgcggc

SEQ ID NO: 740313 - DNA, 25 bp, Artificial sequence
  Synthetic oligonucleotide
tcagggttaaagatatctcacgtac

SEQ ID NO: 740314 - DNA, 25 bp, Artificial sequence
  Synthetic oligonucleotide
tcagggttaaagttatctcacgtac

SEQ ID NO: 740315 - DNA, 25 bp, Artificial sequence
  Synthetic oligonucleotide
atggaaaatagcgatcgctgccagg

SEQ ID NO: 740316 - DNA, 25 bp, Artificial sequence
  Synthetic oligonucleotide
atggaaaatagccatcgctgccagg

SEQ ID NO: 740317 - DNA, 25 bp, Artificial sequence
  Synthetic oligonucleotide
tcgttcactcatcgaaaatagcgat

SEQ ID NO: 740318 - DNA, 25 bp, Artificial sequence
  Synthetic oligonucleotide
tcgttcactcatggaaaatagcgat

SEQ ID NO: 740319 - DNA, 25 bp, Artificial sequence
  Synthetic oligonucleotide
tctatatcttcaggcgcgcggtctg

SEQ ID NO: 740320 - DNA, 25 bp, Artificial sequence
  Synthetic oligonucleotide
ctctagcgttcgtacgcactgattt

SEQ ID NO: 740321 - DNA, 25 bp, Artificial sequence
  Synthetic oligonucleotide
ccagctaaacatccttcatcgtcgg

SEQ ID NO: 740322 - DNA, 25 bp, Artificial sequence
  Synthetic oligonucleotide
acgtgcaaaacacgctctagcgttc

SEQ ID NO: 740323 - DNA, 25 bp, Artificial sequence
  Synthetic oligonucleotide
atgccggtgaacctgcaaaacaggc

SEQ ID NO: 740324 - DNA, 25 bp, Artificial sequence
  Synthetic oligonucleotide
atgccggtgaacgtgcaaaacaggc

SEQ ID NO: 740325 - DNA, 25 bp, Artificial sequence
  Synthetic oligonucleotide
aatgctgtttcactggttatgcggc

SEQ ID NO: 740326 - DNA, 25 bp, Artificial sequence
  Synthetic oligonucleotide
gaccaagtgacagcaatgctgtttc

SEQ ID NO: 740327 - DNA, 25 bp, Artificial sequence
  Synthetic oligonucleotide
ccgggctgccacgaccaagtgacag

SEQ ID NO: 740328 - DNA, 25 bp, Artificial sequence
  Synthetic oligonucleotide
ccagctaaacatgcttcatcgtcgg

SEQ ID NO: 740329 - DNA, 25 bp, Artificial sequence
  Synthetic oligonucleotide
ctctagcgttcgaacgcactgattt

SEQ ID NO: 740330 - DNA, 25 bp, Artificial sequence
  Synthetic oligonucleotide
ccgggctgccaccaccaagtgacag

SEQ ID NO: 740331 - DNA, 25 bp, Artificial sequence
  Synthetic oligonucleotide
tctatatcttcaggcgcgcggtctg

SEQ ID NO: 740332 - DNA, 25 bp, Artificial sequence
  Synthetic oligonucleotide
tctatatcttcacgcgcgcggtctg

SEQ ID NO: 740333 - DNA, 25 bp, Artificial sequence
  Synthetic oligonucleotide
gaagatgttcgcgattatcttctat

SEQ ID NO: 740334 - DNA, 25 bp, Artificial sequence
  Synthetic oligonucleotide
gaagatgttcgccattatcttctat

SEQ ID NO: 740335 - DNA, 25 bp, Artificial sequence
  Synthetic oligonucleotide
gcggcatggtgcaagttgaataacc

SEQ ID NO: 740336 - DNA, 25 bp, Artificial sequence
  Synthetic oligonucleotide
gcggcatggtgctagttgaataacc

SEQ ID NO: 740337 - DNA, 25 bp, Artificial sequence
  Synthetic oligonucleotide
gccaggcgttttctgagcatacctg

SEQ ID NO: 740338 - DNA, 25 bp, Artificial sequence
  Synthetic oligonucleotide
gcaacatttggggcagctaaacatg

SEQ ID NO: 740339 - DNA, 25 bp, Artificial sequence
  Synthetic oligonucleotide
gacatgttcaggcatcgccaggcgt

SEQ ID NO: 740340 - DNA, 25 bp, Artificial sequence
  Synthetic oligonucleotide
gccaggcgttttgtgagcatacctg

SEQ ID NO: 740341 - DNA, 25 bp, Artificial sequence
  Synthetic oligonucleotide
gcaagaacctgaaggacatgttcag

SEQ ID NO: 740342 - DNA, 25 bp, Artificial sequence
  Synthetic oligonucleotide
gcaagaacctgatggacatgttcag

SEQ ID NO: 740343 - DNA, 25 bp, Artificial sequence
  Synthetic oligonucleotide
gagtgatgaggtacgcaagaacctg

SEQ ID NO: 740344 - DNA, 25 bp, Artificial sequence
  Synthetic oligonucleotide
gagtgatgaggttcgcaagaacctg

SEQ ID NO: 740345 - DNA, 25 bp, Artificial sequence
  Synthetic oligonucleotide
taccggtcgatggaacgagtgatga

SEQ ID NO: 740346 - DNA, 25 bp, Artificial sequence
  Synthetic oligonucleotide
taccggtcgatgcaacgagtgatga

SEQ ID NO: 740347 - DNA, 25 bp, Artificial sequence
  Synthetic oligonucleotide
atttgcctgcataaccggtcgatgc

SEQ ID NO: 740348 - DNA, 25 bp, Artificial sequence
  Synthetic oligonucleotide
atttgcctgcattaccggtcgatgc

SEQ ID NO: 740349 - DNA, 25 bp, Artificial sequence
  Synthetic oligonucleotide
atggaaaatagcgatcgctgccagg

SEQ ID NO: 740350 - DNA, 25 bp, Artificial sequence
  Synthetic oligonucleotide
aatgctgtttcagtggttatgcggc

SEQ ID NO: 740351 - DNA, 25 bp, Artificial sequence
  Synthetic oligonucleotide
atgccggtgaacgtgcaaaacaggc

SEQ ID NO: 740352 - DNA, 25 bp, Artificial sequence
  Synthetic oligonucleotide
acgtgcaaaacaggctctagcgttc

SEQ ID NO: 740353 - DNA, 25 bp, Artificial sequence
  Synthetic oligonucleotide
gacatgttcagggatcgccaggcgt

SEQ ID NO: 740354 - DNA, 25 bp, Artificial sequence
  Synthetic oligonucleotide
acgtgcaaaacacgctctagcgttc

SEQ ID NO: 740355 - DNA, 25 bp, Artificial sequence
  Synthetic oligonucleotide
ctctagcgttcgaacgcactgattt

SEQ ID NO: 740356 - DNA, 25 bp, Artificial sequence
  Synthetic oligonucleotide
ctctagcgttcgtacgcactgattt

SEQ ID NO: 740357 - DNA, 25 bp, Artificial sequence
  Synthetic oligonucleotide
tcgttcactcatcgaaaatagcgat

SEQ ID NO: 740358 - DNA, 25 bp, Artificial sequence
  Synthetic oligonucleotide
tcgttcactcatggaaaatagcgat

SEQ ID NO: 740359 - DNA, 25 bp, Artificial sequence
  Synthetic oligonucleotide
atgccggtgaacctgcaaaacaggc

SEQ ID NO: 740360 - DNA, 25 bp, Artificial sequence
  Synthetic oligonucleotide
tcagggttaaagttatctcacgtac

SEQ ID NO: 740361 - DNA, 25 bp, Artificial sequence
  Synthetic oligonucleotide
aatgctgtttcactggttatgcggc

SEQ ID NO: 740362 - DNA, 25 bp, Artificial sequence
  Synthetic oligonucleotide
gaccaagtgacagcaatgctgtttc

SEQ ID NO: 740363 - DNA, 25 bp, Artificial sequence
  Synthetic oligonucleotide
gaccaagtgacaccaatgctgtttc

SEQ ID NO: 740364 - DNA, 25 bp, Artificial sequence
  Synthetic oligonucleotide
ccgggctgccaccaccaagtgacag

SEQ ID NO: 740365 - DNA, 25 bp, Artificial sequence
  Synthetic oligonucleotide
tcagggttaaagatatctcacgtac

SEQ ID NO: 740366 - DNA, 25 bp, Artificial sequence
  Synthetic oligonucleotide
ccgggctgccacgaccaagtgacag

SEQ ID NO: 740367 - DNA, 25 bp, Artificial sequence
  Synthetic oligonucleotide
gcaacatttgggccagctaaacatg

SEQ ID NO: 740368 - DNA, 25 bp, Artificial sequence
  Synthetic oligonucleotide
ccagctaaacatgcttcatcgtcgg

SEQ ID NO: 740369 - DNA, 25 bp, Artificial sequence
  Synthetic oligonucleotide
ccagctaaacatccttcatcgtcgg

SEQ ID NO: 740370 - DNA, 25 bp, Artificial sequence
  Synthetic oligonucleotide
atggaaaatagccatcgctgccagg

SEQ ID NO: 740371 - DNA, 25 bp, Artificial sequence
  Synthetic oligonucleotide
ttcatcagccggattttgttattga

SEQ ID NO: 740372 - DNA, 25 bp, Artificial sequence
  Synthetic oligonucleotide
gaagcgatctttaccgccggaatcc

SEQ ID NO: 740373 - DNA, 25 bp, Artificial sequence
  Synthetic oligonucleotide
gaagcgatcttttccgccggaatcc

SEQ ID NO: 740374 - DNA, 25 bp, Artificial sequence
  Synthetic oligonucleotide
gtacggtcagtttgcgtaaagaaga

SEQ ID NO: 740375 - DNA, 25 bp, Artificial sequence
  Synthetic oligonucleotide
ttccggcgcataaagtcagcaaggt

SEQ ID NO: 740376 - DNA, 25 bp, Artificial sequence
  Synthetic oligonucleotide
aagaattcagcttacgcttccagac

SEQ ID NO: 740377 - DNA, 25 bp, Artificial sequence
  Synthetic oligonucleotide
ttcatcagccggtttttgttattga

SEQ ID NO: 740378 - DNA, 25 bp, Artificial sequence
  Synthetic oligonucleotide
tcatcagccggaatttgttattgat

SEQ ID NO: 740379 - DNA, 25 bp, Artificial sequence
  Synthetic oligonucleotide
tcatcagccggattttgttattgat

SEQ ID NO: 740380 - DNA, 25 bp, Artificial sequence
  Synthetic oligonucleotide
atctcggatacattagaggcaaaga

SEQ ID NO: 740381 - DNA, 25 bp, Artificial sequence
  Synthetic oligonucleotide
atctcggatacaatagaggcaaaga

SEQ ID NO: 740382 - DNA, 25 bp, Artificial sequence
  Synthetic oligonucleotide
tatcccgtcaaacgattccgtttct

SEQ ID NO: 740383 - DNA, 25 bp, Artificial sequence
  Synthetic oligonucleotide
ttccggcgcatatagtcagcaaggt

SEQ ID NO: 740384 - DNA, 25 bp, Artificial sequence
  Synthetic oligonucleotide
gatttgacagaagcggaactctctt

SEQ ID NO: 740385 - DNA, 25 bp, Artificial sequence
  Synthetic oligonucleotide
aagaattcagctaacgcttccagac

SEQ ID NO: 740386 - DNA, 25 bp, Artificial sequence
  Synthetic oligonucleotide
gctgaagcagccggcatattaggcg

SEQ ID NO: 740387 - DNA, 25 bp, Artificial sequence
  Synthetic oligonucleotide
gctgaagcagcccgcatattaggcg

SEQ ID NO: 740388 - DNA, 25 bp, Artificial sequence
  Synthetic oligonucleotide
gtacggtcagttagcgtaaagaaga

SEQ ID NO: 740389 - DNA, 25 bp, Artificial sequence
  Synthetic oligonucleotide
caattcggtcaattgtcactgtcat

SEQ ID NO: 740390 - DNA, 25 bp, Artificial sequence
  Synthetic oligonucleotide
caattcggtcaaatgtcactgtcat

SEQ ID NO: 740391 - DNA, 25 bp, Artificial sequence
  Synthetic oligonucleotide
tatcccgtcaaaggattccgtttct

SEQ ID NO: 740392 - DNA, 25 bp, Artificial sequence
  Synthetic oligonucleotide
gatttgacagaaccggaactctctt

SEQ ID NO: 740393 - DNA, 25 bp, Artificial sequence
  Synthetic oligonucleotide
acaaccggtttcacagaagctgatt

SEQ ID NO: 740394 - DNA, 25 bp, Artificial sequence
  Synthetic oligonucleotide
acaaccggtttctcagaagctgatt

SEQ ID NO: 740395 - DNA, 25 bp, Artificial sequence
  Synthetic oligonucleotide
ttagagcacggactccgtccagttg

SEQ ID NO: 740396 - DNA, 25 bp, Artificial sequence
  Synthetic oligonucleotide
ttagagcacggagtccgtccagttg

SEQ ID NO: 740397 - DNA, 25 bp, Artificial sequence
  Synthetic oligonucleotide
tcttgattgatttaacaacgcccga

SEQ ID NO: 740398 - DNA, 25 bp, Artificial sequence
  Synthetic oligonucleotide
ctcggtgcgatactgatgatgaaat

SEQ ID NO: 740399 - DNA, 25 bp, Artificial sequence
  Synthetic oligonucleotide
acaaccggatgtgttgattgattta

SEQ ID NO: 740400 - DNA, 25 bp, Artificial sequence
  Synthetic oligonucleotide
acaaccggatgtcttgattgattta

SEQ ID NO: 740401 - DNA, 25 bp, Artificial sequence
  Synthetic oligonucleotide
attatctgatgtcatgcctgttgag

SEQ ID NO: 740402 - DNA, 25 bp, Artificial sequence
  Synthetic oligonucleotide
tcttgattgattaaacaacgcccga

SEQ ID NO: 740403 - DNA, 25 bp, Artificial sequence
  Synthetic oligonucleotide
gaaaaagggatccgagccatcatcg

SEQ ID NO: 740404 - DNA, 25 bp, Artificial sequence
  Synthetic oligonucleotide
gaaaaagggatcggagccatcatcg

SEQ ID NO: 740405 - DNA, 25 bp, Artificial sequence
  Synthetic oligonucleotide
ccaaattttgcgctcggtgcgatac

SEQ ID NO: 740406 - DNA, 25 bp, Artificial sequence
  Synthetic oligonucleotide
ctcggtgcgatagtgatgatgaaat

SEQ ID NO: 740407 - DNA, 25 bp, Artificial sequence
  Synthetic oligonucleotide
tcatcatgaccagaagcttgacgca

SEQ ID NO: 740408 - DNA, 25 bp, Artificial sequence
  Synthetic oligonucleotide
tcatcatgaccacaagcttgacgca

SEQ ID NO: 740409 - DNA, 25 bp, Artificial sequence
  Synthetic oligonucleotide
ggccatagaccaaacatacgatcag

SEQ ID NO: 740410 - DNA, 25 bp, Artificial sequence
  Synthetic oligonucleotide
ggccatagaccatacatacgatcag

SEQ ID NO: 740411 - DNA, 25 bp, Artificial sequence
  Synthetic oligonucleotide
acaccacattttgaccttgtagggg

SEQ ID NO: 740412 - DNA, 25 bp, Artificial sequence
  Synthetic oligonucleotide
attatctgatgtgatgcctgttgag

SEQ ID NO: 740413 - DNA, 25 bp, Artificial sequence
  Synthetic oligonucleotide
acaccacattttcaccttgtagggg

SEQ ID NO: 740414 - DNA, 25 bp, Artificial sequence
  Synthetic oligonucleotide
ccaaattttgcggtcggtgcgatac

SEQ ID NO: 740415 - DNA, 25 bp, Artificial sequence
  Synthetic oligonucleotide
cccacagtgatgatgtcgagatcgg

SEQ ID NO: 740416 - DNA, 25 bp, Artificial sequence
  Synthetic oligonucleotide
ccgtttatgtgatgtgtattccatt

SEQ ID NO: 740417 - DNA, 25 bp, Artificial sequence
  Synthetic oligonucleotide
cccacagtgatgttgtcgagatcgg

SEQ ID NO: 740418 - DNA, 25 bp, Artificial sequence
  Synthetic oligonucleotide
ccgaatgtataaagctgacgttctt

SEQ ID NO: 740419 - DNA, 25 bp, Artificial sequence
  Synthetic oligonucleotide
atgaaggtgtttacgaattccgtga

SEQ ID NO: 740420 - DNA, 25 bp, Artificial sequence
  Synthetic oligonucleotide
atgaaggtgttttcgaattccgtga

SEQ ID NO: 740421 - DNA, 25 bp, Artificial sequence
  Synthetic oligonucleotide
gcggaaattcttctgcgcacacttg

SEQ ID NO: 740422 - DNA, 25 bp, Artificial sequence
  Synthetic oligonucleotide
gcggaaattcttgtgcgcacacttg

SEQ ID NO: 740423 - DNA, 25 bp, Artificial sequence
  Synthetic oligonucleotide
ctgcggaaattcttgtgcgcacact

SEQ ID NO: 740424 - DNA, 25 bp, Artificial sequence
  Synthetic oligonucleotide
ccgaatgtataatgctgacgttctt

SEQ ID NO: 740425 - DNA, 25 bp, Artificial sequence
  Synthetic oligonucleotide
ccgtttatgtgaagtgtattccatt

SEQ ID NO: 740426 - DNA, 25 bp, Artificial sequence
  Synthetic oligonucleotide
tgaagattgatctgcttgtgtatgg

SEQ ID NO: 740427 - DNA, 25 bp, Artificial sequence
  Synthetic oligonucleotide
tgaaccggatgtgtcggcattaatc

SEQ ID NO: 740428 - DNA, 25 bp, Artificial sequence
  Synthetic oligonucleotide
tgaaccggatgtctcggcattaatc

SEQ ID NO: 740429 - DNA, 25 bp, Artificial sequence
  Synthetic oligonucleotide
gtcatttttttgcgcgacccgctga

SEQ ID NO: 740430 - DNA, 25 bp, Artificial sequence
  Synthetic oligonucleotide
gtcatttttttgggcgacccgctga

SEQ ID NO: 740431 - DNA, 25 bp, Artificial sequence
  Synthetic oligonucleotide
aaagaatcatgatctatacgcaacc

SEQ ID NO: 740432 - DNA, 25 bp, Artificial sequence
  Synthetic oligonucleotide
aaagaatcatgaactatacgcaacc

SEQ ID NO: 740433 - DNA, 25 bp, Artificial sequence
  Synthetic oligonucleotide
gaaaattgctttgatcgcgcatgac

SEQ ID NO: 740434 - DNA, 25 bp, Artificial sequence
  Synthetic oligonucleotide
gaaaattgctttcatcgcgcatgac

SEQ ID NO: 740435 - DNA, 25 bp, Artificial sequence
  Synthetic oligonucleotide
tgaagattgatcagcttgtgtatgg

SEQ ID NO: 740436 - DNA, 25 bp, Artificial sequence
  Synthetic oligonucleotide
ctgcggaaattcatgtgcgcacact

SEQ ID NO: 740437 - DNA, 25 bp, Artificial sequence
  Synthetic oligonucleotide
tattcatttgtaaccaaggtgctga

SEQ ID NO: 740438 - DNA, 25 bp, Artificial sequence
  Synthetic oligonucleotide
gtgctgaatcttggaggaggtttcg

SEQ ID NO: 740439 - DNA, 25 bp, Artificial sequence
  Synthetic oligonucleotide
gttttgtgttaggagcggaaaaaat

SEQ ID NO: 740440 - DNA, 25 bp, Artificial sequence
  Synthetic oligonucleotide
ggccggttttgtgttagcagcggaa

SEQ ID NO: 740441 - DNA, 25 bp, Artificial sequence
  Synthetic oligonucleotide
gttttgtgttagcagcggaaaaaat

SEQ ID NO: 740442 - DNA, 25 bp, Artificial sequence
  Synthetic oligonucleotide
tattcatttgtatccaaggtgctga

SEQ ID NO: 740443 - DNA, 25 bp, Artificial sequence
  Synthetic oligonucleotide
ttcatttgtatccaaggtgctgaat

SEQ ID NO: 740444 - DNA, 25 bp, Artificial sequence
  Synthetic oligonucleotide
ttcatttgtatcgaaggtgctgaat

SEQ ID NO: 740445 - DNA, 25 bp, Artificial sequence
  Synthetic oligonucleotide
ttgtatccaaggagctgaatcttgg

SEQ ID NO: 740446 - DNA, 25 bp, Artificial sequence
  Synthetic oligonucleotide
atacggccggttatgtgttagcagc

SEQ ID NO: 740447 - DNA, 25 bp, Artificial sequence
  Synthetic oligonucleotide
gtgctgaatcttcgaggaggtttcg

SEQ ID NO: 740448 - DNA, 25 bp, Artificial sequence
  Synthetic oligonucleotide
atacggccggttttgtgttagcagc

SEQ ID NO: 740449 - DNA, 25 bp, Artificial sequence
  Synthetic oligonucleotide
tcatgccactgaatacgttgaaaaa

SEQ ID NO: 740450 - DNA, 25 bp, Artificial sequence
  Synthetic oligonucleotide
tcatgccactgattacgttgaaaaa

SEQ ID NO: 740451 - DNA, 25 bp, Artificial sequence
  Synthetic oligonucleotide
atgccactgaattcgttgaaaaaat

SEQ ID NO: 740452 - DNA, 25 bp, Artificial sequence
  Synthetic oligonucleotide
atgccactgaatacgttgaaaaaat

SEQ ID NO: 740453 - DNA, 25 bp, Artificial sequence
  Synthetic oligonucleotide
gaaccgggccgttctctcgtgggag

SEQ ID NO: 740454 - DNA, 25 bp, Artificial sequence
  Synthetic oligonucleotide
gaaccgggccgtactctcgtgggag

SEQ ID NO: 740455 - DNA, 25 bp, Artificial sequence
  Synthetic oligonucleotide
cgggccgttctctcgtgggagacgc

SEQ ID NO: 740456 - DNA, 25 bp, Artificial sequence
  Synthetic oligonucleotide
cgggccgttctcacgtgggagacgc

SEQ ID NO: 740457 - DNA, 25 bp, Artificial sequence
  Synthetic oligonucleotide
ttgtatccaaggtgctgaatcttgg

SEQ ID NO: 740458 - DNA, 25 bp, Artificial sequence
  Synthetic oligonucleotide
ggccggttttgtcttagcagcggaa

SEQ ID NO: 740459 - DNA, 25 bp, Artificial sequence
  Synthetic oligonucleotide
ggctttaatacgtgagcgtgctaaa

SEQ ID NO: 740460 - DNA, 25 bp, Artificial sequence
  Synthetic oligonucleotide
tagaaatcggaggtgtggatgctct

SEQ ID NO: 740461 - DNA, 25 bp, Artificial sequence
  Synthetic oligonucleotide
ggatgctctctaattagcggagaaa

SEQ ID NO: 740462 - DNA, 25 bp, Artificial sequence
  Synthetic oligonucleotide
ggatgctctctatttagcggagaaa

SEQ ID NO: 740463 - DNA, 25 bp, Artificial sequence
  Synthetic oligonucleotide
agcggagaaataaggtacacctctt

SEQ ID NO: 740464 - DNA, 25 bp, Artificial sequence
  Synthetic oligonucleotide
agcggagaaatatggtacacctctt

SEQ ID NO: 740465 - DNA, 25 bp, Artificial sequence
  Synthetic oligonucleotide
ggagaaatatggaacacctctttac

SEQ ID NO: 740466 - DNA, 25 bp, Artificial sequence
  Synthetic oligonucleotide
ggagaaatatggtacacctctttac

SEQ ID NO: 740467 - DNA, 25 bp, Artificial sequence
  Synthetic oligonucleotide
tacacctctttacgtatatgatgtg

SEQ ID NO: 740468 - DNA, 25 bp, Artificial sequence
  Synthetic oligonucleotide
ggctttaatacgagagcgtgctaaa

SEQ ID NO: 740469 - DNA, 25 bp, Artificial sequence
  Synthetic oligonucleotide
tagaaatcggagctgtggatgctct

SEQ ID NO: 740470 - DNA, 25 bp, Artificial sequence
  Synthetic oligonucleotide
gcaggcgtttatttctgcagggctg

SEQ ID NO: 740471 - DNA, 25 bp, Artificial sequence
  Synthetic oligonucleotide
gcaggcgtttatatctgcagggctg

SEQ ID NO: 740472 - DNA, 25 bp, Artificial sequence
  Synthetic oligonucleotide
atcagtcgcaatgattcagctcgct

SEQ ID NO: 740473 - DNA, 25 bp, Artificial sequence
  Synthetic oligonucleotide
tacacctctttaggtatatgatgtg

SEQ ID NO: 740474 - DNA, 25 bp, Artificial sequence
  Synthetic oligonucleotide
atcagtcgcaatcattcagctcgct

SEQ ID NO: 740475 - DNA, 25 bp, Artificial sequence
  Synthetic oligonucleotide
ggactttctttagatgtcgtatccg

SEQ ID NO: 740476 - DNA, 25 bp, Artificial sequence
  Synthetic oligonucleotide
ggactttctttacatgtcgtatccg

SEQ ID NO: 740477 - DNA, 25 bp, Artificial sequence
  Synthetic oligonucleotide
gagagctatatagggctgttgcagc

SEQ ID NO: 740478 - DNA, 25 bp, Artificial sequence
  Synthetic oligonucleotide
gagagctatatacggctgttgcagc

SEQ ID NO: 740479 - DNA, 25 bp, Artificial sequence
  Synthetic oligonucleotide
cacctctttacgaatatgatgtggc

SEQ ID NO: 740480 - DNA, 25 bp, Artificial sequence
  Synthetic oligonucleotide
cacctctttacgtatatgatgtggc

SEQ ID NO: 740481 - DNA, 25 bp, Artificial sequence
  Synthetic oligonucleotide
agtttggtttcgatcttcataacgg

SEQ ID NO: 740482 - DNA, 25 bp, Artificial sequence
  Synthetic oligonucleotide
gaacgcatccacattcatggaaaca

SEQ ID NO: 740483 - DNA, 25 bp, Artificial sequence
  Synthetic oligonucleotide
gaacgcatccactttcatggaaaca

SEQ ID NO: 740484 - DNA, 25 bp, Artificial sequence
  Synthetic oligonucleotide
gcttcttgaagagctatgtaaagaa

SEQ ID NO: 740485 - DNA, 25 bp, Artificial sequence
  Synthetic oligonucleotide
cttcggatcacgcccggagtagaag

SEQ ID NO: 740486 - DNA, 25 bp, Artificial sequence
  Synthetic oligonucleotide
tacgcatgactacattacaacgggc

SEQ ID NO: 740487 - DNA, 25 bp, Artificial sequence
  Synthetic oligonucleotide
tacgcatgactagattacaacgggc

SEQ ID NO: 740488 - DNA, 25 bp, Artificial sequence
  Synthetic oligonucleotide
tgactacattactacgggccaggaa

SEQ ID NO: 740489 - DNA, 25 bp, Artificial sequence
  Synthetic oligonucleotide
tgactacattacaacgggccaggaa

SEQ ID NO: 740490 - DNA, 25 bp, Artificial sequence
  Synthetic oligonucleotide
gactacattacaacgggccaggaag

SEQ ID NO: 740491 - DNA, 25 bp, Artificial sequence
  Synthetic oligonucleotide
gcttcttgaagacctatgtaaagaa

SEQ ID NO: 740492 - DNA, 25 bp, Artificial sequence
  Synthetic oligonucleotide
agtttggtttcgttcttcataacgg

SEQ ID NO: 740493 - DNA, 25 bp, Artificial sequence
  Synthetic oligonucleotide
tttcgatcttcataacggacaaact

SEQ ID NO: 740494 - DNA, 25 bp, Artificial sequence
  Synthetic oligonucleotide
tttcgatcttcaaaacggacaaact

SEQ ID NO: 740495 - DNA, 25 bp, Artificial sequence
  Synthetic oligonucleotide
actgaacgggcctttgaacaagtat

SEQ ID NO: 740496 - DNA, 25 bp, Artificial sequence
  Synthetic oligonucleotide
actgaacgggccattgaacaagtat

SEQ ID NO: 740497 - DNA, 25 bp, Artificial sequence
  Synthetic oligonucleotide
ctgaacgggccattgaacaagtatt

SEQ ID NO: 740498 - DNA, 25 bp, Artificial sequence
  Synthetic oligonucleotide
ctgaacgggccaatgaacaagtatt

SEQ ID NO: 740499 - DNA, 25 bp, Artificial sequence
  Synthetic oligonucleotide
tccattgccatatcggctcgcaaat

SEQ ID NO: 740500 - DNA, 25 bp, Artificial sequence
  Synthetic oligonucleotide
tccattgccataacggctcgcaaat

SEQ ID NO: 740501 - DNA, 25 bp, Artificial sequence
  Synthetic oligonucleotide
gactacattacatcgggccaggaag

SEQ ID NO: 740502 - DNA, 25 bp, Artificial sequence
  Synthetic oligonucleotide
cttcggatcacggccggagtagaag

SEQ ID NO: 740503 - DNA, 25 bp, Artificial sequence
  Synthetic oligonucleotide
atggtcatgctggcgcaggatgatc

SEQ ID NO: 740504 - DNA, 25 bp, Artificial sequence
  Synthetic oligonucleotide
gagtcacgtccgactaaaaccggat

SEQ ID NO: 740505 - DNA, 25 bp, Artificial sequence
  Synthetic oligonucleotide
ctgtctcccgatgaaaacatatctt

SEQ ID NO: 740506 - DNA, 25 bp, Artificial sequence
  Synthetic oligonucleotide
ctgtctcccgatcaaaacatatctt

SEQ ID NO: 740507 - DNA, 25 bp, Artificial sequence
  Synthetic oligonucleotide
gagctctaggccgaaaacgacctta

SEQ ID NO: 740508 - DNA, 25 bp, Artificial sequence
  Synthetic oligonucleotide
atcggggtcattcccaatgatatgg

SEQ ID NO: 740509 - DNA, 25 bp, Artificial sequence
  Synthetic oligonucleotide
atggtcatgctgccgcaggatgatc

SEQ ID NO: 740510 - DNA, 25 bp, Artificial sequence
  Synthetic oligonucleotide
atcggggtcattgccaatgatatgg

SEQ ID NO: 740511 - DNA, 25 bp, Artificial sequence
  Synthetic oligonucleotide
gaccatcccgagctgaatatcgggg

SEQ ID NO: 740512 - DNA, 25 bp, Artificial sequence
  Synthetic oligonucleotide
gaccatcccgaggtgaatatcgggg

SEQ ID NO: 740513 - DNA, 25 bp, Artificial sequence
  Synthetic oligonucleotide
ctgtcaaaaattgagtcacgtccga

SEQ ID NO: 740514 - DNA, 25 bp, Artificial sequence
  Synthetic oligonucleotide
gagctctaggcccaaaacgacctta

SEQ ID NO: 740515 - DNA, 25 bp, Artificial sequence
  Synthetic oligonucleotide
tccggggcgctggatagagtgctgt

SEQ ID NO: 740516 - DNA, 25 bp, Artificial sequence
  Synthetic oligonucleotide
tcaaaaattgagacacgtccgacta

SEQ ID NO: 740517 - DNA, 25 bp, Artificial sequence
  Synthetic oligonucleotide
ctgtcaaaaattcagtcacgtccga

SEQ ID NO: 740518 - DNA, 25 bp, Artificial sequence
  Synthetic oligonucleotide
tcaaaaattgagtcacgtccgacta

SEQ ID NO: 740519 - DNA, 25 bp, Artificial sequence
  Synthetic oligonucleotide
gagtcacgtccgtctaaaaccggat

SEQ ID NO: 740520 - DNA, 25 bp, Artificial sequence
  Synthetic oligonucleotide
cctgtcaaaaatagagtcacgtccg

SEQ ID NO: 740521 - DNA, 25 bp, Artificial sequence
  Synthetic oligonucleotide
cctgtcaaaaattgagtcacgtccg

SEQ ID NO: 740522 - DNA, 25 bp, Artificial sequence
  Synthetic oligonucleotide
gtctgcattttcatggagaaattta

SEQ ID NO: 740523 - DNA, 25 bp, Artificial sequence
  Synthetic oligonucleotide
gtctgcattttcttggagaaattta

SEQ ID NO: 740524 - DNA, 25 bp, Artificial sequence
  Synthetic oligonucleotide
tccggggcgctgcatagagtgctgt

SEQ ID NO: 740525 - DNA, 25 bp, Artificial sequence
  Synthetic oligonucleotide
ttttccattctagaccatggtaaaa

SEQ ID NO: 740526 - DNA, 25 bp, Artificial sequence
  Synthetic oligonucleotide
gtagctgattctggaagcaacgttc

SEQ ID NO: 740527 - DNA, 25 bp, Artificial sequence
  Synthetic oligonucleotide
ggaggataggtcaggtgcgttatct

SEQ ID NO: 740528 - DNA, 25 bp, Artificial sequence
  Synthetic oligonucleotide
ggaggataggtctggtgcgttatct

SEQ ID NO: 740529 - DNA, 25 bp, Artificial sequence
  Synthetic oligonucleotide
gtagctgattctcgaagcaacgttc

SEQ ID NO: 740530 - DNA, 25 bp, Artificial sequence
  Synthetic oligonucleotide
aggtcgatttaactagaagtgcgtt

SEQ ID NO: 740531 - DNA, 25 bp, Artificial sequence
  Synthetic oligonucleotide
aggtcgatttaagtagaagtgcgtt

SEQ ID NO: 740532 - DNA, 25 bp, Artificial sequence
  Synthetic oligonucleotide
gcagatgccgttcaaaaggtcgatt

SEQ ID NO: 740533 - DNA, 25 bp, Artificial sequence
  Synthetic oligonucleotide
gcagatgccgttgaaaaggtcgatt

SEQ ID NO: 740534 - DNA, 25 bp, Artificial sequence
  Synthetic oligonucleotide
gattcagtagcacatgccgttcaaa

SEQ ID NO: 740535 - DNA, 25 bp, Artificial sequence
  Synthetic oligonucleotide
ctggaagcaacgttctttccattca

SEQ ID NO: 740536 - DNA, 25 bp, Artificial sequence
  Synthetic oligonucleotide
tgacactgtctaacagtacgtcggc

SEQ ID NO: 740537 - DNA, 25 bp, Artificial sequence
  Synthetic oligonucleotide
gattcagtagcagatgccgttcaaa

SEQ ID NO: 740538 - DNA, 25 bp, Artificial sequence
  Synthetic oligonucleotide
ttttccattctacaccatggtaaaa

SEQ ID NO: 740539 - DNA, 25 bp, Artificial sequence
  Synthetic oligonucleotide
tttggaggatagctcaggtgcgtta

SEQ ID NO: 740540 - DNA, 25 bp, Artificial sequence
  Synthetic oligonucleotide
gtgacactgtctttcagtacgtcgg

SEQ ID NO: 740541 - DNA, 25 bp, Artificial sequence
  Synthetic oligonucleotide
tttggaggataggtcaggtgcgtta

SEQ ID NO: 740542 - DNA, 25 bp, Artificial sequence
  Synthetic oligonucleotide
ctggaagcaacgatctttccattca

SEQ ID NO: 740543 - DNA, 25 bp, Artificial sequence
  Synthetic oligonucleotide
gtgacactgtctatcagtacgtcgg

SEQ ID NO: 740544 - DNA, 25 bp, Artificial sequence
  Synthetic oligonucleotide
tatcagtacgtccgcaatggaagaa

SEQ ID NO: 740545 - DNA, 25 bp, Artificial sequence
  Synthetic oligonucleotide
tgacactgtctatcagtacgtcggc

SEQ ID NO: 740546 - DNA, 25 bp, Artificial sequence
  Synthetic oligonucleotide
tatcagtacgtcggcaatggaagaa

SEQ ID NO: 740547 - DNA, 25 bp, Artificial sequence
  Synthetic oligonucleotide
ggagtgtatagatgcagccgttgca

SEQ ID NO: 740548 - DNA, 25 bp, Artificial sequence
  Synthetic oligonucleotide
ggagtgtatagaagcagccgttgca

SEQ ID NO: 740549 - DNA, 25 bp, Artificial sequence
  Synthetic oligonucleotide
gttgcaggcgaacttgattttgctt

SEQ ID NO: 740550 - DNA, 25 bp, Artificial sequence
  Synthetic oligonucleotide
gttgcaggcgaagttgattttgctt

SEQ ID NO: 740551 - DNA, 25 bp, Artificial sequence
  Synthetic oligonucleotide
aatcgtgggtgatatgacgttgccg

SEQ ID NO: 740552 - DNA, 25 bp, Artificial sequence
  Synthetic oligonucleotide
aatcgtgggtgaaatgacgttgccg

SEQ ID NO: 740553 - DNA, 25 bp, Artificial sequence
  Synthetic oligonucleotide
gctcgacaaaatttactcacattca

SEQ ID NO: 740554 - DNA, 25 bp, Artificial sequence
  Synthetic oligonucleotide
gctcgacaaaatatactcacattca

SEQ ID NO: 740555 - DNA, 25 bp, Artificial sequence
  Synthetic oligonucleotide
atttcttcatcgtcattttccttcc

SEQ ID NO: 740556 - DNA, 25 bp, Artificial sequence
  Synthetic oligonucleotide
gaacatgttgcttaccgcaccattc

SEQ ID NO: 740557 - DNA, 25 bp, Artificial sequence
  Synthetic oligonucleotide
ccgaacatgttggttaccgcaccat

SEQ ID NO: 740558 - DNA, 25 bp, Artificial sequence
  Synthetic oligonucleotide
gaacatgttgctaaccgcaccattc

SEQ ID NO: 740559 - DNA, 25 bp, Artificial sequence
  Synthetic oligonucleotide
ccgaacatgttgcttaccgcaccat

SEQ ID NO: 740560 - DNA, 25 bp, Artificial sequence
  Synthetic oligonucleotide
atatgaatacgccaattctaccggg

SEQ ID NO: 740561 - DNA, 25 bp, Artificial sequence
  Synthetic oligonucleotide
tacatttacacaactagcagtcagt

SEQ ID NO: 740562 - DNA, 25 bp, Artificial sequence
  Synthetic oligonucleotide
tacatttacacatctagcagtcagt

SEQ ID NO: 740563 - DNA, 25 bp, Artificial sequence
  Synthetic oligonucleotide
ctacatttacacatctagcagtcag

SEQ ID NO: 740564 - DNA, 25 bp, Artificial sequence
  Synthetic oligonucleotide
ctacatttacacttctagcagtcag

SEQ ID NO: 740565 - DNA, 25 bp, Artificial sequence
  Synthetic oligonucleotide
tcggttatttaggtccagcagctac

SEQ ID NO: 740566 - DNA, 25 bp, Artificial sequence
  Synthetic oligonucleotide
tcggttatttagctccagcagctac

SEQ ID NO: 740567 - DNA, 25 bp, Artificial sequence
  Synthetic oligonucleotide
atatgaatacgcgaattctaccggg

SEQ ID NO: 740568 - DNA, 25 bp, Artificial sequence
  Synthetic oligonucleotide
atttcttcatcgacattttccttcc

SEQ ID NO: 740569 - DNA, 25 bp, Artificial sequence
  Synthetic oligonucleotide
tcctcattgctgcgatcatgtccaa

SEQ ID NO: 740570 - DNA, 25 bp, Artificial sequence
  Synthetic oligonucleotide
gaaggagtttccttatgccgatgcc

SEQ ID NO: 740571 - DNA, 25 bp, Artificial sequence
  Synthetic oligonucleotide
gaaggagtttccatatgccgatgcc

SEQ ID NO: 740572 - DNA, 25 bp, Artificial sequence
  Synthetic oligonucleotide
acgcgagagacgtgcttccgaagga

SEQ ID NO: 740573 - DNA, 25 bp, Artificial sequence
  Synthetic oligonucleotide
acgcgagagacgagcttccgaagga

SEQ ID NO: 740574 - DNA, 25 bp, Artificial sequence
  Synthetic oligonucleotide
gacgtagtcgttgtcattccttttt

SEQ ID NO: 740575 - DNA, 25 bp, Artificial sequence
  Synthetic oligonucleotide
gacgtagtcgttctcattccttttt

SEQ ID NO: 740576 - DNA, 25 bp, Artificial sequence
  Synthetic oligonucleotide
gacgagacccaattgatccgcgtcc

SEQ ID NO: 740577 - DNA, 25 bp, Artificial sequence
  Synthetic oligonucleotide
gacgagacccaaatgatccgcgtcc

SEQ ID NO: 740578 - DNA, 25 bp, Artificial sequence
  Synthetic oligonucleotide
gtgatcggcctggatgaggatgacg

SEQ ID NO: 740579 - DNA, 25 bp, Artificial sequence
  Synthetic oligonucleotide
tcctcattgctgggatcatgtccaa

SEQ ID NO: 740580 - DNA, 25 bp, Artificial sequence
  Synthetic oligonucleotide
atgcttgtgcctgagctgtcaaaag

SEQ ID NO: 740581 - DNA, 25 bp, Artificial sequence
  Synthetic oligonucleotide
aaagaacagctcccgcttcatttcc

SEQ ID NO: 740582 - DNA, 25 bp, Artificial sequence
  Synthetic oligonucleotide
aaagaacagctcgcgcttcatttcc

SEQ ID NO: 740583 - DNA, 25 bp, Artificial sequence
  Synthetic oligonucleotide
gtgatcggcctgcatgaggatgacg

SEQ ID NO: 740584 - DNA, 25 bp, Artificial sequence
  Synthetic oligonucleotide
gaagggcgcataaggaacggctctc

SEQ ID NO: 740585 - DNA, 25 bp, Artificial sequence
  Synthetic oligonucleotide
ggattggccgcttgtcgggaaaatc

SEQ ID NO: 740586 - DNA, 25 bp, Artificial sequence
  Synthetic oligonucleotide
atgcttgtgcctcagctgtcaaaag

SEQ ID NO: 740587 - DNA, 25 bp, Artificial sequence
  Synthetic oligonucleotide
gaaggatatgttgcatcagccgtac

SEQ ID NO: 740588 - DNA, 25 bp, Artificial sequence
  Synthetic oligonucleotide
gaaggatatgttccatcagccgtac

SEQ ID NO: 740589 - DNA, 25 bp, Artificial sequence
  Synthetic oligonucleotide
ggattggccgctagtcgggaaaatc

SEQ ID NO: 740590 - DNA, 25 bp, Artificial sequence
  Synthetic oligonucleotide
gaagggcgcatatggaacggctctc

SEQ ID NO: 740591 - DNA, 25 bp, Artificial sequence
  Synthetic oligonucleotide
aaactgctgcctacgaagtgtgcga

SEQ ID NO: 740592 - DNA, 25 bp, Artificial sequence
  Synthetic oligonucleotide
aaactgctgccttcgaagtgtgcga

SEQ ID NO: 740593 - DNA, 25 bp, Artificial sequence
  Synthetic oligonucleotide
caggccttccgaaaatgcgcggctt

SEQ ID NO: 740594 - DNA, 25 bp, Artificial sequence
  Synthetic oligonucleotide
gtaacagatcaatcaccggcgctaa

SEQ ID NO: 740595 - DNA, 25 bp, Artificial sequence
  Synthetic oligonucleotide
caggccttccgataatgcgcggctt

SEQ ID NO: 740596 - DNA, 25 bp, Artificial sequence
  Synthetic oligonucleotide
agcgcctgatgtattagcgatcccg

SEQ ID NO: 740597 - DNA, 25 bp, Artificial sequence
  Synthetic oligonucleotide
gcatatgcagcccgtgctaacatga

SEQ ID NO: 740598 - DNA, 25 bp, Artificial sequence
  Synthetic oligonucleotide
gtaacagatcaaacaccggcgctaa

SEQ ID NO: 740599 - DNA, 25 bp, Artificial sequence
  Synthetic oligonucleotide
gtcaacaggtaacacttccgctgct

SEQ ID NO: 740600 - DNA, 25 bp, Artificial sequence
  Synthetic oligonucleotide
agcgcctgatgttttagcgatcccg

SEQ ID NO: 740601 - DNA, 25 bp, Artificial sequence
  Synthetic oligonucleotide
gtcaacaggtaagacttccgctgct

SEQ ID NO: 740602 - DNA, 25 bp, Artificial sequence
  Synthetic oligonucleotide
gcatatgcagccggtgctaacatga

SEQ ID NO: 740603 - DNA, 25 bp, Artificial sequence
  Synthetic oligonucleotide
gaaatgcattgtgatcatcccgaac

SEQ ID NO: 740604 - DNA, 25 bp, Artificial sequence
  Synthetic oligonucleotide
gaaatgcattgtcatcatcccgaac

SEQ ID NO: 740605 - DNA, 25 bp, Artificial sequence
  Synthetic oligonucleotide
aactcgctcaagctgtcatgtacgg

SEQ ID NO: 740606 - DNA, 25 bp, Artificial sequence
  Synthetic oligonucleotide
gacggaaactttcacgatgcgctta

SEQ ID NO: 740607 - DNA, 25 bp, Artificial sequence
  Synthetic oligonucleotide
gacggaaactttgacgatgcgctta

SEQ ID NO: 740608 - DNA, 25 bp, Artificial sequence
  Synthetic oligonucleotide
gatgcgcttaaatttgtccgttcca

SEQ ID NO: 740609 - DNA, 25 bp, Artificial sequence
  Synthetic oligonucleotide
gatgcgcttaaaattgtccgttcca

SEQ ID NO: 740610 - DNA, 25 bp, Artificial sequence
  Synthetic oligonucleotide
gtcaacccttaccgcattgaaggcc

SEQ ID NO: 740611 - DNA, 25 bp, Artificial sequence
  Synthetic oligonucleotide
gtcaacccttacggcattgaaggcc

SEQ ID NO: 740612 - DNA, 25 bp, Artificial sequence
  Synthetic oligonucleotide
aactcgctcaaggtgtcatgtacgg

SEQ ID NO: 740613 - DNA, 25 bp, Artificial sequence
  Synthetic oligonucleotide
gataacctgatctaccaagtggcta

SEQ ID NO: 740614 - DNA, 25 bp, Artificial sequence
  Synthetic oligonucleotide
gaacgaagccgagatgctgttctct

SEQ ID NO: 740615 - DNA, 25 bp, Artificial sequence
  Synthetic oligonucleotide
gaacgaagccgacatgctgttctct

SEQ ID NO: 740616 - DNA, 25 bp, Artificial sequence
  Synthetic oligonucleotide
tctgtcactgttgccggaagcacag

SEQ ID NO: 740617 - DNA, 25 bp, Artificial sequence
  Synthetic oligonucleotide
tctgtcactgttcccggaagcacag

SEQ ID NO: 740618 - DNA, 25 bp, Artificial sequence
  Synthetic oligonucleotide
gccccggctttgtttcagtcggaat

SEQ ID NO: 740619 - DNA, 25 bp, Artificial sequence
  Synthetic oligonucleotide
gccccggctttgattcagtcggaat

SEQ ID NO: 740620 - DNA, 25 bp, Artificial sequence
  Synthetic oligonucleotide
tcagtcggaatgccgctcagcagat

SEQ ID NO: 740621 - DNA, 25 bp, Artificial sequence
  Synthetic oligonucleotide
aaatgcctcctgtccatgtgaaggt

SEQ ID NO: 740622 - DNA, 25 bp, Artificial sequence
  Synthetic oligonucleotide
aaatcaagcctgtcacattgccgac

SEQ ID NO: 740623 - DNA, 25 bp, Artificial sequence
  Synthetic oligonucleotide
aaatgcctcctgaccatgtgaaggt

SEQ ID NO: 740624 - DNA, 25 bp, Artificial sequence
  Synthetic oligonucleotide
gataacctgatcaaccaagtggcta

SEQ ID NO: 740625 - DNA, 25 bp, Artificial sequence
  Synthetic oligonucleotide
tcagtcggaatggcgctcagcagat

SEQ ID NO: 740626 - DNA, 25 bp, Artificial sequence
  Synthetic oligonucleotide
aaatcaagcctgacacattgccgac

SEQ ID NO: 740627 - DNA, 25 bp, Artificial sequence
  Synthetic oligonucleotide
tatcagctgatcccccgtgtagaag

SEQ ID NO: 740628 - DNA, 25 bp, Artificial sequence
  Synthetic oligonucleotide
tatcagctgatcgcccgtgtagaag

SEQ ID NO: 740629 - DNA, 25 bp, Artificial sequence
  Synthetic oligonucleotide
gttcttgcgcgtgtatcgcaggagt

SEQ ID NO: 740630 - DNA, 25 bp, Artificial sequence
  Synthetic oligonucleotide
gttcttgcgcgtctatcgcaggagt

SEQ ID NO: 740631 - DNA, 25 bp, Artificial sequence
  Synthetic oligonucleotide
agatccgaacactgcggtcgacatt

SEQ ID NO: 740632 - DNA, 25 bp, Artificial sequence
  Synthetic oligonucleotide
agatccgaacacagcggtcgacatt

SEQ ID NO: 740633 - DNA, 25 bp, Artificial sequence
  Synthetic oligonucleotide
tgaaatccttcaggcatatcagctg

SEQ ID NO: 740634 - DNA, 25 bp, Artificial sequence
  Synthetic oligonucleotide
tgaaatccttcacgcatatcagctg

SEQ ID NO: 740635 - DNA, 25 bp, Artificial sequence
  Synthetic oligonucleotide
gggataacgaactacagcaacgtct

SEQ ID NO: 740636 - DNA, 25 bp, Artificial sequence
  Synthetic oligonucleotide
agactcaggcgaagtgctttatggc

SEQ ID NO: 740637 - DNA, 25 bp, Artificial sequence
  Synthetic oligonucleotide
tatggcaggcgctaactcgattttc

SEQ ID NO: 740638 - DNA, 25 bp, Artificial sequence
  Synthetic oligonucleotide
gcaaactcgattatctacggttgca

SEQ ID NO: 740639 - DNA, 25 bp, Artificial sequence
  Synthetic oligonucleotide
agactcaggcgatgtgctttatggc

SEQ ID NO: 740640 - DNA, 25 bp, Artificial sequence
  Synthetic oligonucleotide
acaacagcaacgtcttgaacaggcg

SEQ ID NO: 740641 - DNA, 25 bp, Artificial sequence
  Synthetic oligonucleotide
tatggcaggcgcaaactcgattttc

SEQ ID NO: 740642 - DNA, 25 bp, Artificial sequence
  Synthetic oligonucleotide
gggataacgaacaacagcaacgtct

SEQ ID NO: 740643 - DNA, 25 bp, Artificial sequence
  Synthetic oligonucleotide
actggggctaaatccgcagcaaact

SEQ ID NO: 740644 - DNA, 25 bp, Artificial sequence
  Synthetic oligonucleotide
actggggctaaaaccgcagcaaact

SEQ ID NO: 740645 - DNA, 25 bp, Artificial sequence
  Synthetic oligonucleotide
gcaaactggggcaaaatccgcagca

SEQ ID NO: 740646 - DNA, 25 bp, Artificial sequence
  Synthetic oligonucleotide
gcaaactggggctaaatccgcagca

SEQ ID NO: 740647 - DNA, 25 bp, Artificial sequence
  Synthetic oligonucleotide
tttctacggttggaaactgctgacc

SEQ ID NO: 740648 - DNA, 25 bp, Artificial sequence
  Synthetic oligonucleotide
acaacagcaacgacttgaacaggcg

SEQ ID NO: 740649 - DNA, 25 bp, Artificial sequence
  Synthetic oligonucleotide
tgccaacctctttcgtgcgcctttc

SEQ ID NO: 740650 - DNA, 25 bp, Artificial sequence
  Synthetic oligonucleotide
gaacagactcagccgatgtgcttta

SEQ ID NO: 740651 - DNA, 25 bp, Artificial sequence
  Synthetic oligonucleotide
gaacagactcaggcgatgtgcttta

SEQ ID NO: 740652 - DNA, 25 bp, Artificial sequence
  Synthetic oligonucleotide
caacctcttacgagcgcctttctgc

SEQ ID NO: 740653 - DNA, 25 bp, Artificial sequence
  Synthetic oligonucleotide
caacctcttacgtgcgcctttctgc

SEQ ID NO: 740654 - DNA, 25 bp, Artificial sequence
  Synthetic oligonucleotide
tttctacggttgcaaactgctgacc

SEQ ID NO: 740655 - DNA, 25 bp, Artificial sequence
  Synthetic oligonucleotide
tgccaacctcttacgtgcgcctttc

SEQ ID NO: 740656 - DNA, 25 bp, Artificial sequence
  Synthetic oligonucleotide
gcaaactcgattttctacggttgca

SEQ ID NO: 740657 - DNA, 25 bp, Artificial sequence
  Synthetic oligonucleotide
aagccgagcggttgatggaagttga

SEQ ID NO: 740658 - DNA, 25 bp, Artificial sequence
  Synthetic oligonucleotide
ttcgatcctcgtcaggtgcaggtca

SEQ ID NO: 740659 - DNA, 25 bp, Artificial sequence
  Synthetic oligonucleotide
tcgatcctcgtcaggtgcaggtcag

SEQ ID NO: 740660 - DNA, 25 bp, Artificial sequence
  Synthetic oligonucleotide
tttcgatcctcgtcaggtgcaggtc

SEQ ID NO: 740661 - DNA, 25 bp, Artificial sequence
  Synthetic oligonucleotide
tcgatcctcgtctggtgcaggtcag

SEQ ID NO: 740662 - DNA, 25 bp, Artificial sequence
  Synthetic oligonucleotide
tcgcgctacaaaaccgggctggaag

SEQ ID NO: 740663 - DNA, 25 bp, Artificial sequence
  Synthetic oligonucleotide
cggcaggatcgaggcgcttctgtat

SEQ ID NO: 740664 - DNA, 25 bp, Artificial sequence
  Synthetic oligonucleotide
cgcgctacaaaaccgggctggaagc

SEQ ID NO: 740665 - DNA, 25 bp, Artificial sequence
  Synthetic oligonucleotide
cgcgctacaaaagcgggctggaagc

SEQ ID NO: 740666 - DNA, 25 bp, Artificial sequence
  Synthetic oligonucleotide
aagccgagcggtagatggaagttga

SEQ ID NO: 740667 - DNA, 25 bp, Artificial sequence
  Synthetic oligonucleotide
gagcggttgatggaagttgaacagg

SEQ ID NO: 740668 - DNA, 25 bp, Artificial sequence
  Synthetic oligonucleotide
ttcgatcctcgtgaggtgcaggtca

SEQ ID NO: 740669 - DNA, 25 bp, Artificial sequence
  Synthetic oligonucleotide
cggcaggatcgacgcgcttctgtat

SEQ ID NO: 740670 - DNA, 25 bp, Artificial sequence
  Synthetic oligonucleotide
gagcggttgatgcaagttgaacagg

SEQ ID NO: 740671 - DNA, 25 bp, Artificial sequence
  Synthetic oligonucleotide
tcgcgctacaaatccgggctggaag

SEQ ID NO: 740672 - DNA, 25 bp, Artificial sequence
  Synthetic oligonucleotide
catttcgatcctggtcaggtgcagg

SEQ ID NO: 740673 - DNA, 25 bp, Artificial sequence
  Synthetic oligonucleotide
catttcgatcctcgtcaggtgcagg

SEQ ID NO: 740674 - DNA, 25 bp, Artificial sequence
  Synthetic oligonucleotide
ctggatctgctgattgaagcgcagc

SEQ ID NO: 740675 - DNA, 25 bp, Artificial sequence
  Synthetic oligonucleotide
ctggatctgctgtttgaagcgcagc

SEQ ID NO: 740676 - DNA, 25 bp, Artificial sequence
  Synthetic oligonucleotide
gctggatctgctgtttgaagcgcag

SEQ ID NO: 740677 - DNA, 25 bp, Artificial sequence
  Synthetic oligonucleotide
gctggatctgctctttgaagcgcag

SEQ ID NO: 740678 - DNA, 25 bp, Artificial sequence
  Synthetic oligonucleotide
tttcgatcctcgacaggtgcaggtc

SEQ ID NO: 740679 - DNA, 25 bp, Artificial sequence
  Synthetic oligonucleotide
ccggattattgctgcaactggcaaa

SEQ ID NO: 740680 - DNA, 25 bp, Artificial sequence
  Synthetic oligonucleotide
tgccgggatcaatgtctgttctggc

SEQ ID NO: 740681 - DNA, 25 bp, Artificial sequence
  Synthetic oligonucleotide
ccgggatcaaagtctgttctggcgg

SEQ ID NO: 740682 - DNA, 25 bp, Artificial sequence
  Synthetic oligonucleotide
cgggatcaaagtgtgttctggcggc

SEQ ID NO: 740683 - DNA, 25 bp, Artificial sequence
  Synthetic oligonucleotide
gcattgtgggcttaggcgaaacggt

SEQ ID NO: 740684 - DNA, 25 bp, Artificial sequence
  Synthetic oligonucleotide
gcattgtgggctaaggcgaaacggt

SEQ ID NO: 740685 - DNA, 25 bp, Artificial sequence
  Synthetic oligonucleotide
aaaagatcgcgccggattattgctg

SEQ ID NO: 740686 - DNA, 25 bp, Artificial sequence
  Synthetic oligonucleotide
aaaagatcgcgcgggattattgctg

SEQ ID NO: 740687 - DNA, 25 bp, Artificial sequence
  Synthetic oligonucleotide
tgccgggatcaaagtctgttctggc

SEQ ID NO: 740688 - DNA, 25 bp, Artificial sequence
  Synthetic oligonucleotide
agatcgcgccggtttattgctgcaa

SEQ ID NO: 740689 - DNA, 25 bp, Artificial sequence
  Synthetic oligonucleotide
ccgggatcaaagactgttctggcgg

SEQ ID NO: 740690 - DNA, 25 bp, Artificial sequence
  Synthetic oligonucleotide
ccggattattgcagcaactggcaaa

SEQ ID NO: 740691 - DNA, 25 bp, Artificial sequence
  Synthetic oligonucleotide
cggaaagcgtgccaatcaacatgct

SEQ ID NO: 740692 - DNA, 25 bp, Artificial sequence
  Synthetic oligonucleotide
cggaaagcgtgcgaatcaacatgct

SEQ ID NO: 740693 - DNA, 25 bp, Artificial sequence
  Synthetic oligonucleotide
agatcgcgccggattattgctgcaa

SEQ ID NO: 740694 - DNA, 25 bp, Artificial sequence
  Synthetic oligonucleotide
cacgcacttatctggaacgcctcga

SEQ ID NO: 740695 - DNA, 25 bp, Artificial sequence
  Synthetic oligonucleotide
gctgggcacgttgagtgaatctcag

SEQ ID NO: 740696 - DNA, 25 bp, Artificial sequence
  Synthetic oligonucleotide
gctgggcacgttcagtgaatctcag

SEQ ID NO: 740697 - DNA, 25 bp, Artificial sequence
  Synthetic oligonucleotide
tgtatgacgctgggcacgttgagtg

SEQ ID NO: 740698 - DNA, 25 bp, Artificial sequence
  Synthetic oligonucleotide
cgggatcaaagtctgttctggcggc

SEQ ID NO: 740699 - DNA, 25 bp, Artificial sequence
  Synthetic oligonucleotide
tgtatgacgctgcgcacgttgagtg

SEQ ID NO: 740700 - DNA, 25 bp, Artificial sequence
  Synthetic oligonucleotide
cacgcacttatcaggaacgcctcga

SEQ ID NO: 740701 - DNA, 25 bp, Artificial sequence
  Synthetic oligonucleotide
accgccagatgatatcgaacagtcg

SEQ ID NO: 740702 - DNA, 25 bp, Artificial sequence
  Synthetic oligonucleotide
atcaacatcataatcagcccatcac

SEQ ID NO: 740703 - DNA, 25 bp, Artificial sequence
  Synthetic oligonucleotide
cgctggtgcagggatcgttacccga

SEQ ID NO: 740704 - DNA, 25 bp, Artificial sequence
  Synthetic oligonucleotide
cgctggtgcaggcatcgttacccga

SEQ ID NO: 740705 - DNA, 25 bp, Artificial sequence
  Synthetic oligonucleotide
gtggacgagcgtgcgcatgctaatc

SEQ ID NO: 740706 - DNA, 25 bp, Artificial sequence
  Synthetic oligonucleotide
tcatattcagccgatcacgctgtgg

SEQ ID NO: 740707 - DNA, 25 bp, Artificial sequence
  Synthetic oligonucleotide
accgccagatgaaatcgaacagtcg

SEQ ID NO: 740708 - DNA, 25 bp, Artificial sequence
  Synthetic oligonucleotide
cagcgattgcaagtggcctggccgc

SEQ ID NO: 740709 - DNA, 25 bp, Artificial sequence
  Synthetic oligonucleotide
gaacggcgtgcaatatcaacatcat

SEQ ID NO: 740710 - DNA, 25 bp, Artificial sequence
  Synthetic oligonucleotide
gaacggcgtgcattatcaacatcat

SEQ ID NO: 740711 - DNA, 25 bp, Artificial sequence
  Synthetic oligonucleotide
gtggacgagcgtccgcatgctaatc

SEQ ID NO: 740712 - DNA, 25 bp, Artificial sequence
  Synthetic oligonucleotide
tcatattcagcccatcacgctgtgg

SEQ ID NO: 740713 - DNA, 25 bp, Artificial sequence
  Synthetic oligonucleotide
cacgctgtggttagatgatgcgctc

SEQ ID NO: 740714 - DNA, 25 bp, Artificial sequence
  Synthetic oligonucleotide
atcaacatcatattcagcccatcac

SEQ ID NO: 740715 - DNA, 25 bp, Artificial sequence
  Synthetic oligonucleotide
cagcgattgcaactggcctggccgc

SEQ ID NO: 740716 - DNA, 25 bp, Artificial sequence
  Synthetic oligonucleotide
tattaacgcgttggcagttgcagcg

SEQ ID NO: 740717 - DNA, 25 bp, Artificial sequence
  Synthetic oligonucleotide
tattaacgcgttcgcagttgcagcg

SEQ ID NO: 740718 - DNA, 25 bp, Artificial sequence
  Synthetic oligonucleotide
cggtgccacgcatcttcatgaaggg

SEQ ID NO: 740719 - DNA, 25 bp, Artificial sequence
  Synthetic oligonucleotide
cggtgccacgcaacttcatgaaggg

SEQ ID NO: 740720 - DNA, 25 bp, Artificial sequence
  Synthetic oligonucleotide
agtgccatgcgtacgctgaaaggca

SEQ ID NO: 740721 - DNA, 25 bp, Artificial sequence
  Synthetic oligonucleotide
agtgccatgcgttcgctgaaaggca

SEQ ID NO: 740722 - DNA, 25 bp, Artificial sequence
  Synthetic oligonucleotide
cacgctgtggtttgatgatgcgctc

SEQ ID NO: 740723 - DNA, 25 bp, Artificial sequence
  Synthetic oligonucleotide
aggatgccgcagaccattatctggc

SEQ ID NO: 740724 - DNA, 25 bp, Artificial sequence
  Synthetic oligonucleotide
cacggcactccgcgagctgtatcgg

SEQ ID NO: 740725 - DNA, 25 bp, Artificial sequence
  Synthetic oligonucleotide
ctgccgttagcgtctgcgacgttcg

SEQ ID NO: 740726 - DNA, 25 bp, Artificial sequence
  Synthetic oligonucleotide
cacggcactccgggagctgtatcgg

SEQ ID NO: 740727 - DNA, 25 bp, Artificial sequence
  Synthetic oligonucleotide
atggagcaatctcgcagtgcagtgg

SEQ ID NO: 740728 - DNA, 25 bp, Artificial sequence
  Synthetic oligonucleotide
atggagcaatctggcagtgcagtgg

SEQ ID NO: 740729 - DNA, 25 bp, Artificial sequence
  Synthetic oligonucleotide
gcatggagcaatgtcgcagtgcagt

SEQ ID NO: 740730 - DNA, 25 bp, Artificial sequence
  Synthetic oligonucleotide
gcatggagcaatctcgcagtgcagt

SEQ ID NO: 740731 - DNA, 25 bp, Artificial sequence
  Synthetic oligonucleotide
acgttcgatcttccatggagcaatc

SEQ ID NO: 740732 - DNA, 25 bp, Artificial sequence
  Synthetic oligonucleotide
acgttcgatcttgcatggagcaatc

SEQ ID NO: 740733 - DNA, 25 bp, Artificial sequence
  Synthetic oligonucleotide
ctgccgttagcgactgcgacgttcg

SEQ ID NO: 740734 - DNA, 25 bp, Artificial sequence
  Synthetic oligonucleotide
aggatgccgcagtccattatctggc

SEQ ID NO: 740735 - DNA, 25 bp, Artificial sequence
  Synthetic oligonucleotide
atgcagatctactgcgccagagtgc

SEQ ID NO: 740736 - DNA, 25 bp, Artificial sequence
  Synthetic oligonucleotide
ccagaaggatgcggcagaccattat

SEQ ID NO: 740737 - DNA, 25 bp, Artificial sequence
  Synthetic oligonucleotide
cgccgccaatgcttgttcaggcacg

SEQ ID NO: 740738 - DNA, 25 bp, Artificial sequence
  Synthetic oligonucleotide
cgccgccaatgcatgttcaggcacg

SEQ ID NO: 740739 - DNA, 25 bp, Artificial sequence
  Synthetic oligonucleotide
acgcgggttgtggacctggctggat

SEQ ID NO: 740740 - DNA, 25 bp, Artificial sequence
  Synthetic oligonucleotide
acgcgggttgtgcacctggctggat

SEQ ID NO: 740741 - DNA, 25 bp, Artificial sequence
  Synthetic oligonucleotide
gtaaatacaccctcgtactggacgc

SEQ ID NO: 740742 - DNA, 25 bp, Artificial sequence
  Synthetic oligonucleotide
gtaaatacacccacgtactggacgc

SEQ ID NO: 740743 - DNA, 25 bp, Artificial sequence
  Synthetic oligonucleotide
atgcagatctacagcgccagagtgc

SEQ ID NO: 740744 - DNA, 25 bp, Artificial sequence
  Synthetic oligonucleotide
ccagaaggatgccgcagaccattat

SEQ ID NO: 740745 - DNA, 25 bp, Artificial sequence
  Synthetic oligonucleotide
gccggtgatactggtagttggtgtg

SEQ ID NO: 740746 - DNA, 25 bp, Artificial sequence
  Synthetic oligonucleotide
gccggtgatactcgtagttggtgtg

SEQ ID NO: 740747 - DNA, 25 bp, Artificial sequence
  Synthetic oligonucleotide
aacaactgccggagatactggtagt

SEQ ID NO: 740748 - DNA, 25 bp, Artificial sequence
  Synthetic oligonucleotide
aacaactgccggtgatactggtagt

SEQ ID NO: 740749 - DNA, 25 bp, Artificial sequence
  Synthetic oligonucleotide
acttttgcagattgggtaacacagg

SEQ ID NO: 740750 - DNA, 25 bp, Artificial sequence
  Synthetic oligonucleotide
acttttgcagatagggtaacacagg

SEQ ID NO: 740751 - DNA, 25 bp, Artificial sequence
  Synthetic oligonucleotide
aactcggctgtattaatcacgcgat

SEQ ID NO: 740752 - DNA, 25 bp, Artificial sequence
  Synthetic oligonucleotide
tgacactttcacttttgcagattgg

SEQ ID NO: 740753 - DNA, 25 bp, Artificial sequence
  Synthetic oligonucleotide
gtcacgctgaatatatgaccacgct

SEQ ID NO: 740754 - DNA, 25 bp, Artificial sequence
  Synthetic oligonucleotide
tgacactttcacatttgcagattgg

SEQ ID NO: 740755 - DNA, 25 bp, Artificial sequence
  Synthetic oligonucleotide
aactcggctgtaataatcacgcgat

SEQ ID NO: 740756 - DNA, 25 bp, Artificial sequence
  Synthetic oligonucleotide
cacaggtaatacaacacgccggact

SEQ ID NO: 740757 - DNA, 25 bp, Artificial sequence
  Synthetic oligonucleotide
cacaggtaatactacacgccggact

SEQ ID NO: 740758 - DNA, 25 bp, Artificial sequence
  Synthetic oligonucleotide
acaacacgccggtctgactctggcg

SEQ ID NO: 740759 - DNA, 25 bp, Artificial sequence
  Synthetic oligonucleotide
tgctgggagagatcccctggcttgc

SEQ ID NO: 740760 - DNA, 25 bp, Artificial sequence
  Synthetic oligonucleotide
gtcacgctgaatttatgaccacgct

SEQ ID NO: 740761 - DNA, 25 bp, Artificial sequence
  Synthetic oligonucleotide
tcacgctgaataaatgaccacgctc

SEQ ID NO: 740762 - DNA, 25 bp, Artificial sequence
  Synthetic oligonucleotide
tcacgctgaatatatgaccacgctc

SEQ ID NO: 740763 - DNA, 25 bp, Artificial sequence
  Synthetic oligonucleotide
ttctgacactttcacttttgcagat

SEQ ID NO: 740764 - DNA, 25 bp, Artificial sequence
  Synthetic oligonucleotide
ttctgacactttgacttttgcagat

SEQ ID NO: 740765 - DNA, 25 bp, Artificial sequence
  Synthetic oligonucleotide
acaacacgccggactgactctggcg

SEQ ID NO: 740766 - DNA, 25 bp, Artificial sequence
  Synthetic oligonucleotide
tgctgggagagaacccctggcttgc

SEQ ID NO: 740767 - DNA, 25 bp, Artificial sequence
  Synthetic oligonucleotide
gcagcaggctaccggacggcaggtt

SEQ ID NO: 740768 - DNA, 25 bp, Artificial sequence
  Synthetic oligonucleotide
gaatcattggtattgagcgccggat

SEQ ID NO: 740769 - DNA, 25 bp, Artificial sequence
  Synthetic oligonucleotide
gcagcaggctacgggacggcaggtt

SEQ ID NO: 740770 - DNA, 25 bp, Artificial sequence
  Synthetic oligonucleotide
cctctggcagcgaaaagaccccgga

SEQ ID NO: 740771 - DNA, 25 bp, Artificial sequence
  Synthetic oligonucleotide
cctctggcagcgtaaagaccccgga

SEQ ID NO: 740772 - DNA, 25 bp, Artificial sequence
  Synthetic oligonucleotide
ctggcagcgaaaagaccccggaagg

SEQ ID NO: 740773 - DNA, 25 bp, Artificial sequence
  Synthetic oligonucleotide
ctggcagcgaaatgaccccggaagg

SEQ ID NO: 740774 - DNA, 25 bp, Artificial sequence
  Synthetic oligonucleotide
agcctgcagctgcattacgcaacag

SEQ ID NO: 740775 - DNA, 25 bp, Artificial sequence
  Synthetic oligonucleotide
agcctgcagctggattacgcaacag

SEQ ID NO: 740776 - DNA, 25 bp, Artificial sequence
  Synthetic oligonucleotide
cctgcagctggaatacgcaacagta

SEQ ID NO: 740777 - DNA, 25 bp, Artificial sequence
  Synthetic oligonucleotide
cctgcagctggattacgcaacagta

SEQ ID NO: 740778 - DNA, 25 bp, Artificial sequence
  Synthetic oligonucleotide
cttacaccttcgcagaacccacttc

SEQ ID NO: 740779 - DNA, 25 bp, Artificial sequence
  Synthetic oligonucleotide
acgcaacagtaattccttacacctt

SEQ ID NO: 740780 - DNA, 25 bp, Artificial sequence
  Synthetic oligonucleotide
gggcagaccgattgaatcattggta

SEQ ID NO: 740781 - DNA, 25 bp, Artificial sequence
  Synthetic oligonucleotide
gaatcattggtaatgagcgccggat

SEQ ID NO: 740782 - DNA, 25 bp, Artificial sequence
  Synthetic oligonucleotide
cttacaccttcggagaacccacttc

SEQ ID NO: 740783 - DNA, 25 bp, Artificial sequence
  Synthetic oligonucleotide
gtaaatccttactccttcgcagaac

SEQ ID NO: 740784 - DNA, 25 bp, Artificial sequence
  Synthetic oligonucleotide
gtaaatccttacaccttcgcagaac

SEQ ID NO: 740785 - DNA, 25 bp, Artificial sequence
  Synthetic oligonucleotide
cgcaacagtaaatccttacaccttc

SEQ ID NO: 740786 - DNA, 25 bp, Artificial sequence
  Synthetic oligonucleotide
cgcaacagtaaaaccttacaccttc

SEQ ID NO: 740787 - DNA, 25 bp, Artificial sequence
  Synthetic oligonucleotide
acgcaacagtaaatccttacacctt

SEQ ID NO: 740788 - DNA, 25 bp, Artificial sequence
  Synthetic oligonucleotide
gggcagaccgatagaatcattggta

SEQ ID NO: 740789 - DNA, 25 bp, Artificial sequence
  Synthetic oligonucleotide
ggtcgagcgatggatttccgtctct

SEQ ID NO: 740790 - DNA, 25 bp, Artificial sequence
  Synthetic oligonucleotide
ggtcgagcgatgcatttccgtctct

SEQ ID NO: 740791 - DNA, 25 bp, Artificial sequence
  Synthetic oligonucleotide
cgctggttagcagcgcaggtgtaga

SEQ ID NO: 740792 - DNA, 25 bp, Artificial sequence
  Synthetic oligonucleotide
cgctggttagcaccgcaggtgtaga

SEQ ID NO: 740793 - DNA, 25 bp, Artificial sequence
  Synthetic oligonucleotide
aacgaaaacgctcgttagcaccgca

SEQ ID NO: 740794 - DNA, 25 bp, Artificial sequence
  Synthetic oligonucleotide
aacgaaaacgctggttagcaccgca

SEQ ID NO: 740795 - DNA, 25 bp, Artificial sequence
  Synthetic oligonucleotide
gttaatccatattggcagaacgaaa

SEQ ID NO: 740796 - DNA, 25 bp, Artificial sequence
  Synthetic oligonucleotide
tagctgatgatcggaataactacct

SEQ ID NO: 740797 - DNA, 25 bp, Artificial sequence
  Synthetic oligonucleotide
aagatatctcacgtactgacggtgg

SEQ ID NO: 740798 - DNA, 25 bp, Artificial sequence
  Synthetic oligonucleotide
ctgttttgccggctcagaaaaaatg

SEQ ID NO: 740799 - DNA, 25 bp, Artificial sequence
  Synthetic oligonucleotide
gttaatccatataggcagaacgaaa

SEQ ID NO: 740800 - DNA, 25 bp, Artificial sequence
  Synthetic oligonucleotide
tagctgatgatccgaataactacct

SEQ ID NO: 740801 - DNA, 25 bp, Artificial sequence
  Synthetic oligonucleotide
atgatccgaatatctacctgttttg

SEQ ID NO: 740802 - DNA, 25 bp, Artificial sequence
  Synthetic oligonucleotide
atgatccgaataactacctgttttg

SEQ ID NO: 740803 - DNA, 25 bp, Artificial sequence
  Synthetic oligonucleotide
ataactacctgttttgccgggtcag

SEQ ID NO: 740804 - DNA, 25 bp, Artificial sequence
  Synthetic oligonucleotide
ccagctatcaactcgcgccctggaa

SEQ ID NO: 740805 - DNA, 25 bp, Artificial sequence
  Synthetic oligonucleotide
ctgttttgccgggtcagaaaaaatg

SEQ ID NO: 740806 - DNA, 25 bp, Artificial sequence
  Synthetic oligonucleotide
aaaaaatggtgtagccgcgccatct

SEQ ID NO: 740807 - DNA, 25 bp, Artificial sequence
  Synthetic oligonucleotide
aaaaaatggtgttgccgcgccatct

SEQ ID NO: 740808 - DNA, 25 bp, Artificial sequence
  Synthetic oligonucleotide
ccagctatcaacacgcgccctggaa

SEQ ID NO: 740809 - DNA, 25 bp, Artificial sequence
  Synthetic oligonucleotide
aagatatctcacctactgacggtgg

SEQ ID NO: 740810 - DNA, 25 bp, Artificial sequence
  Synthetic oligonucleotide
ataactacctgtattgccgggtcag

SEQ ID NO: 740811 - DNA, 25 bp, Artificial sequence
  Synthetic oligonucleotide
gatgttcgcgataatcttctatatc

SEQ ID NO: 740812 - DNA, 25 bp, Artificial sequence
  Synthetic oligonucleotide
gatcgccaggcgatttctgagcata

SEQ ID NO: 740813 - DNA, 25 bp, Artificial sequence
  Synthetic oligonucleotide
gggattgcttataacaccctgttac

SEQ ID NO: 740814 - DNA, 25 bp, Artificial sequence
  Synthetic oligonucleotide
tctgtccgtttgccggtcgtgggcg

SEQ ID NO: 740815 - DNA, 25 bp, Artificial sequence
  Synthetic oligonucleotide
tctgtccgtttggcggtcgtgggcg

SEQ ID NO: 740816 - DNA, 25 bp, Artificial sequence
  Synthetic oligonucleotide
cggaaatggtttcccgcagaacctg

SEQ ID NO: 740817 - DNA, 25 bp, Artificial sequence
  Synthetic oligonucleotide
gatcgccaggcgttttctgagcata

SEQ ID NO: 740818 - DNA, 25 bp, Artificial sequence
  Synthetic oligonucleotide
gatgttcgcgattatcttctatatc

SEQ ID NO: 740819 - DNA, 25 bp, Artificial sequence
  Synthetic oligonucleotide
ttgggccagctatacatgcttcatc

SEQ ID NO: 740820 - DNA, 25 bp, Artificial sequence
  Synthetic oligonucleotide
ttgggccagctaaacatgcttcatc

SEQ ID NO: 740821 - DNA, 25 bp, Artificial sequence
  Synthetic oligonucleotide
gctgtttcactgcttatgcggcgga

SEQ ID NO: 740822 - DNA, 25 bp, Artificial sequence
  Synthetic oligonucleotide
atcgctgccaggatatacgtaatct

SEQ ID NO: 740823 - DNA, 25 bp, Artificial sequence
  Synthetic oligonucleotide
gccggtgaacgtgcaaaacaggctc

SEQ ID NO: 740824 - DNA, 25 bp, Artificial sequence
  Synthetic oligonucleotide
gccggtgaacgtccaaaacaggctc

SEQ ID NO: 740825 - DNA, 25 bp, Artificial sequence
  Synthetic oligonucleotide
gcaaaacaggctctagcgttcgaac

SEQ ID NO: 740826 - DNA, 25 bp, Artificial sequence
  Synthetic oligonucleotide
gcaaaacaggctgtagcgttcgaac

SEQ ID NO: 740827 - DNA, 25 bp, Artificial sequence
  Synthetic oligonucleotide
gcactgatttcgtccaggttcgttc

SEQ ID NO: 740828 - DNA, 25 bp, Artificial sequence
  Synthetic oligonucleotide
gcactgatttcgaccaggttcgttc

SEQ ID NO: 740829 - DNA, 25 bp, Artificial sequence
  Synthetic oligonucleotide
atcgctgccaggttatacgtaatct

SEQ ID NO: 740830 - DNA, 25 bp, Artificial sequence
  Synthetic oligonucleotide
gctgtttcactggttatgcggcgga

SEQ ID NO: 740831 - DNA, 25 bp, Artificial sequence
  Synthetic oligonucleotide
cggaaatggtttgccgcagaacctg

SEQ ID NO: 740832 - DNA, 25 bp, Artificial sequence
  Synthetic oligonucleotide
gggattgcttattacaccctgttac

SEQ ID NO: 740833 - DNA, 25 bp, Artificial sequence
  Synthetic oligonucleotide
tctacgatggcaagtcgtgcctcgt

SEQ ID NO: 740834 - DNA, 25 bp, Artificial sequence
  Synthetic oligonucleotide
ggttaagccgcttttagcgtgtgtg

SEQ ID NO: 740835 - DNA, 25 bp, Artificial sequence
  Synthetic oligonucleotide
ggttaagccgctattagcgtgtgtg

SEQ ID NO: 740836 - DNA, 25 bp, Artificial sequence
  Synthetic oligonucleotide
atgacttatccaaagtcctaagtcc

SEQ ID NO: 740837 - DNA, 25 bp, Artificial sequence
  Synthetic oligonucleotide
atgacttatccatagtcctaagtcc

SEQ ID NO: 740838 - DNA, 25 bp, Artificial sequence
  Synthetic oligonucleotide
tgtcgtatgggactttcaagtacct

SEQ ID NO: 740839 - DNA, 25 bp, Artificial sequence
  Synthetic oligonucleotide
tgtcgtatgggagtttcaagtacct

SEQ ID NO: 740840 - DNA, 25 bp, Artificial sequence
  Synthetic oligonucleotide
aacttgtcgtatgggactttcaagt

SEQ ID NO: 740841 - DNA, 25 bp, Artificial sequence
  Synthetic oligonucleotide
tctacgatggcatgtcgtgcctcgt

SEQ ID NO: 740842 - DNA, 25 bp, Artificial sequence
  Synthetic oligonucleotide
aacttgtcgtatcggactttcaagt

SEQ ID NO: 740843 - DNA, 25 bp, Artificial sequence
  Synthetic oligonucleotide
ttctcgtgtagaatatcagctaata

SEQ ID NO: 740844 - DNA, 25 bp, Artificial sequence
  Synthetic oligonucleotide
ttctcgtgtagattatcagctaata

SEQ ID NO: 740845 - DNA, 25 bp, Artificial sequence
  Synthetic oligonucleotide
gtagaatatcagctaatagggtcgg

SEQ ID NO: 740846 - DNA, 25 bp, Artificial sequence
  Synthetic oligonucleotide
gtagaatatcaggtaatagggtcgg

SEQ ID NO: 740847 - DNA, 25 bp, Artificial sequence
  Synthetic oligonucleotide
tgacgttcgtcaagagtcgcataat

SEQ ID NO: 740848 - DNA, 25 bp, Artificial sequence
  Synthetic oligonucleotide
tgacgttcgtcatgagtcgcataat

SEQ ID NO: 740849 - DNA, 25 bp, Artificial sequence
  Synthetic oligonucleotide
tcaagagtcgcaaaatctcagaatc

SEQ ID NO: 740850 - DNA, 25 bp, Artificial sequence
  Synthetic oligonucleotide
tcaagagtcgcataatctcagaatc

SEQ ID NO: 740851 - DNA, 25 bp, Artificial sequence
  Synthetic oligonucleotide
gttcacggctattaaacagcgtcat

SEQ ID NO: 740852 - DNA, 25 bp, Artificial sequence
  Synthetic oligonucleotide
ccaatgaccatatacggcgtattaa

SEQ ID NO: 740853 - DNA, 25 bp, Artificial sequence
  Synthetic oligonucleotide
ccaatgaccataaacggcgtattaa

SEQ ID NO: 740854 - DNA, 25 bp, Artificial sequence
  Synthetic oligonucleotide
gttcacggctataaaacagcgtcat

SEQ ID NO: 740855 - DNA, 25 bp, Artificial sequence
  Synthetic oligonucleotide
ccaatgaccataaacggcgtattaa

SEQ ID NO: 740856 - DNA, 25 bp, Artificial sequence
  Synthetic oligonucleotide
gttcacggctataaaacagcgtcat

SEQ ID NO: 740857 - DNA, 25 bp, Artificial sequence
  Synthetic oligonucleotide
aacttgtcgtatcggactttcaagt

SEQ ID NO: 740858 - DNA, 25 bp, Artificial sequence
  Synthetic oligonucleotide
aacttgtcgtatgggactttcaagt

SEQ ID NO: 740859 - DNA, 25 bp, Artificial sequence
  Synthetic oligonucleotide
tgtcgtatgggactttcaagtacct

SEQ ID NO: 740860 - DNA, 25 bp, Artificial sequence
  Synthetic oligonucleotide
tgtcgtatgggagtttcaagtacct

SEQ ID NO: 740861 - DNA, 25 bp, Artificial sequence
  Synthetic oligonucleotide
atgacttatccatagtcctaagtcc

SEQ ID NO: 740862 - DNA, 25 bp, Artificial sequence
  Synthetic oligonucleotide
atgacttatccaaagtcctaagtcc

SEQ ID NO: 740863 - DNA, 25 bp, Artificial sequence
  Synthetic oligonucleotide
ggttaagccgctattagcgtgtgtg

SEQ ID NO: 740864 - DNA, 25 bp, Artificial sequence
  Synthetic oligonucleotide
ggttaagccgcttttagcgtgtgtg

SEQ ID NO: 740865 - DNA, 25 bp, Artificial sequence
  Synthetic oligonucleotide
tctacgatggcatgtcgtgcctcgt

SEQ ID NO: 740866 - DNA, 25 bp, Artificial sequence
  Synthetic oligonucleotide
tcaagagtcgcataatctcagaatc

SEQ ID NO: 740867 - DNA, 25 bp, Artificial sequence
  Synthetic oligonucleotide
tctacgatggcaagtcgtgcctcgt

SEQ ID NO: 740868 - DNA, 25 bp, Artificial sequence
  Synthetic oligonucleotide
tcaagagtcgcaaaatctcagaatc

SEQ ID NO: 740869 - DNA, 25 bp, Artificial sequence
  Synthetic oligonucleotide
ccaatgaccatatacggcgtattaa

SEQ ID NO: 740870 - DNA, 25 bp, Artificial sequence
  Synthetic oligonucleotide
tgacgttcgtcatgagtcgcataat

SEQ ID NO: 740871 - DNA, 25 bp, Artificial sequence
  Synthetic oligonucleotide
tgacgttcgtcaagagtcgcataat

SEQ ID NO: 740872 - DNA, 25 bp, Artificial sequence
  Synthetic oligonucleotide
gtagaatatcagctaatagggtcgg

SEQ ID NO: 740873 - DNA, 25 bp, Artificial sequence
  Synthetic oligonucleotide
gtagaatatcaggtaatagggtcgg

SEQ ID NO: 740874 - DNA, 25 bp, Artificial sequence
  Synthetic oligonucleotide
ttctcgtgtagaatatcagctaata

SEQ ID NO: 740875 - DNA, 25 bp, Artificial sequence
  Synthetic oligonucleotide
ttctcgtgtagattatcagctaata

SEQ ID NO: 740876 - DNA, 25 bp, Artificial sequence
  Synthetic oligonucleotide
gttcacggctattaaacagcgtcat

SEQ ID NO: 740877 - DNA, 25 bp, Artificial sequence
  Synthetic oligonucleotide
ctcgatggaagagagttatacccat

SEQ ID NO: 740878 - DNA, 25 bp, Artificial sequence
  Synthetic oligonucleotide
ctcgatggaagacagttatacccat

SEQ ID NO: 740879 - DNA, 25 bp, Artificial sequence
  Synthetic oligonucleotide
cgacgaaccttatactcgatggaag

SEQ ID NO: 740880 - DNA, 25 bp, Artificial sequence
  Synthetic oligonucleotide
cgacgaaccttaaactcgatggaag

SEQ ID NO: 740881 - DNA, 25 bp, Artificial sequence
  Synthetic oligonucleotide
acatatcctaattcaggcgcgacga

SEQ ID NO: 740882 - DNA, 25 bp, Artificial sequence
  Synthetic oligonucleotide
acatatcctaatacaggcgcgacga

SEQ ID NO: 740883 - DNA, 25 bp, Artificial sequence
  Synthetic oligonucleotide
cggtgcgattaagtcgactgccgcg

SEQ ID NO: 740884 - DNA, 25 bp, Artificial sequence
  Synthetic oligonucleotide
actccgagaactagcatctaagcac

SEQ ID NO: 740885 - DNA, 25 bp, Artificial sequence
  Synthetic oligonucleotide
tattgaccaaacagcggtgcgatta

SEQ ID NO: 740886 - DNA, 25 bp, Artificial sequence
  Synthetic oligonucleotide
aatgttaagtgctcgaccacagatc

SEQ ID NO: 740887 - DNA, 25 bp, Artificial sequence
  Synthetic oligonucleotide
cggtgcgattaactcgactgccgcg

SEQ ID NO: 740888 - DNA, 25 bp, Artificial sequence
  Synthetic oligonucleotide
actccgagaacttgcatctaagcac

SEQ ID NO: 740889 - DNA, 25 bp, Artificial sequence
  Synthetic oligonucleotide
gaactagcatctaagcactcggctc

SEQ ID NO: 740890 - DNA, 25 bp, Artificial sequence
  Synthetic oligonucleotide
gaactagcatcttagcactcggctc

SEQ ID NO: 740891 - DNA, 25 bp, Artificial sequence
  Synthetic oligonucleotide
tcggctctaatgataagtgctcgac

SEQ ID NO: 740892 - DNA, 25 bp, Artificial sequence
  Synthetic oligonucleotide
ttatttgggccggcagagttatgtt

SEQ ID NO: 740893 - DNA, 25 bp, Artificial sequence
  Synthetic oligonucleotide
aatgttaagtgcacgaccacagatc

SEQ ID NO: 740894 - DNA, 25 bp, Artificial sequence
  Synthetic oligonucleotide
gtgccaagtacgttggctcacgtct

SEQ ID NO: 740895 - DNA, 25 bp, Artificial sequence
  Synthetic oligonucleotide
gtgccaagtacgatggctcacgtct

SEQ ID NO: 740896 - DNA, 25 bp, Artificial sequence
  Synthetic oligonucleotide
tattgaccaaactgcggtgcgatta

SEQ ID NO: 740897 - DNA, 25 bp, Artificial sequence
  Synthetic oligonucleotide
ttatttgggccgccagagttatgtt

SEQ ID NO: 740898 - DNA, 25 bp, Artificial sequence
  Synthetic oligonucleotide
tcggctctaatgttaagtgctcgac

SEQ ID NO: 740899 - DNA, 25 bp, Artificial sequence
  Synthetic oligonucleotide
tattgaccaaactgcggtgcgatta

SEQ ID NO: 740900 - DNA, 25 bp, Artificial sequence
  Synthetic oligonucleotide
ttatttgggccgccagagttatgtt

SEQ ID NO: 740901 - DNA, 25 bp, Artificial sequence
  Synthetic oligonucleotide
tattgaccaaacagcggtgcgatta

SEQ ID NO: 740902 - DNA, 25 bp, Artificial sequence
  Synthetic oligonucleotide
cggtgcgattaactcgactgccgcg

SEQ ID NO: 740903 - DNA, 25 bp, Artificial sequence
  Synthetic oligonucleotide
cggtgcgattaagtcgactgccgcg

SEQ ID NO: 740904 - DNA, 25 bp, Artificial sequence
  Synthetic oligonucleotide
acatatcctaattcaggcgcgacga

SEQ ID NO: 740905 - DNA, 25 bp, Artificial sequence
  Synthetic oligonucleotide
acatatcctaatacaggcgcgacga

SEQ ID NO: 740906 - DNA, 25 bp, Artificial sequence
  Synthetic oligonucleotide
cgacgaaccttatactcgatggaag

SEQ ID NO: 740907 - DNA, 25 bp, Artificial sequence
  Synthetic oligonucleotide
cgacgaaccttaaactcgatggaag

SEQ ID NO: 740908 - DNA, 25 bp, Artificial sequence
  Synthetic oligonucleotide
ctcgatggaagagagttatacccat

SEQ ID NO: 740909 - DNA, 25 bp, Artificial sequence
  Synthetic oligonucleotide
ctcgatggaagacagttatacccat

SEQ ID NO: 740910 - DNA, 25 bp, Artificial sequence
  Synthetic oligonucleotide
ttatttgggccggcagagttatgtt

SEQ ID NO: 740911 - DNA, 25 bp, Artificial sequence
  Synthetic oligonucleotide
actccgagaacttgcatctaagcac

SEQ ID NO: 740912 - DNA, 25 bp, Artificial sequence
  Synthetic oligonucleotide
gtgccaagtacgatggctcacgtct

SEQ ID NO: 740913 - DNA, 25 bp, Artificial sequence
  Synthetic oligonucleotide
gtgccaagtacgttggctcacgtct

SEQ ID NO: 740914 - DNA, 25 bp, Artificial sequence
  Synthetic oligonucleotide
aatgttaagtgcacgaccacagatc

SEQ ID NO: 740915 - DNA, 25 bp, Artificial sequence
  Synthetic oligonucleotide
aatgttaagtgctcgaccacagatc

SEQ ID NO: 740916 - DNA, 25 bp, Artificial sequence
  Synthetic oligonucleotide
tcggctctaatgataagtgctcgac

SEQ ID NO: 740917 - DNA, 25 bp, Artificial sequence
  Synthetic oligonucleotide
tcggctctaatgttaagtgctcgac

SEQ ID NO: 740918 - DNA, 25 bp, Artificial sequence
  Synthetic oligonucleotide
gaactagcatctaagcactcggctc

SEQ ID NO: 740919 - DNA, 25 bp, Artificial sequence
  Synthetic oligonucleotide
gaactagcatcttagcactcggctc

SEQ ID NO: 740920 - DNA, 25 bp, Artificial sequence
  Synthetic oligonucleotide
actccgagaactagcatctaagcac

SEQ ID NO: 740921 - DNA, 25 bp, Artificial sequence
  Synthetic oligonucleotide
ggttacgatgacagctaagccatta

SEQ ID NO: 740922 - DNA, 25 bp, Artificial sequence
  Synthetic oligonucleotide
atggctgtgcctaacgaatctggga

SEQ ID NO: 740923 - DNA, 25 bp, Artificial sequence
  Synthetic oligonucleotide
ttcgacgaggcgttacatattctga

SEQ ID NO: 740924 - DNA, 25 bp, Artificial sequence
  Synthetic oligonucleotide
tatatcgtggacccaaagtcgatac

SEQ ID NO: 740925 - DNA, 25 bp, Artificial sequence
  Synthetic oligonucleotide
tatatcgtggacgcaaagtcgatac

SEQ ID NO: 740926 - DNA, 25 bp, Artificial sequence
  Synthetic oligonucleotide
gtcgatacgtcccattaagcgacgt

SEQ ID NO: 740927 - DNA, 25 bp, Artificial sequence
  Synthetic oligonucleotide
gtcgatacgtccgattaagcgacgt

SEQ ID NO: 740928 - DNA, 25 bp, Artificial sequence
  Synthetic oligonucleotide
tataccctcgggatacgaattatgg

SEQ ID NO: 740929 - DNA, 25 bp, Artificial sequence
  Synthetic oligonucleotide
tataccctcgggttacgaattatgg

SEQ ID NO: 740930 - DNA, 25 bp, Artificial sequence
  Synthetic oligonucleotide
ttcgacgaggcgatacatattctga

SEQ ID NO: 740931 - DNA, 25 bp, Artificial sequence
  Synthetic oligonucleotide
atggctgtgccttacgaatctggga

SEQ ID NO: 740932 - DNA, 25 bp, Artificial sequence
  Synthetic oligonucleotide
ccgtcctattggatactattccgtg

SEQ ID NO: 740933 - DNA, 25 bp, Artificial sequence
  Synthetic oligonucleotide
ccgtcctattggttactattccgtg

SEQ ID NO: 740934 - DNA, 25 bp, Artificial sequence
  Synthetic oligonucleotide
ccgtcactatgtaacgcttgacgta

SEQ ID NO: 740935 - DNA, 25 bp, Artificial sequence
  Synthetic oligonucleotide
taggcttacgcggatgagctctagg

SEQ ID NO: 740936 - DNA, 25 bp, Artificial sequence
  Synthetic oligonucleotide
ggttacgatgactgctaagccatta

SEQ ID NO: 740937 - DNA, 25 bp, Artificial sequence
  Synthetic oligonucleotide
ttacgcgacattgtgcaaagttacg

SEQ ID NO: 740938 - DNA, 25 bp, Artificial sequence
  Synthetic oligonucleotide
ttacgcgacattctgcaaagttacg

SEQ ID NO: 740939 - DNA, 25 bp, Artificial sequence
  Synthetic oligonucleotide
gtgataatttcgacgaggcgttaca

SEQ ID NO: 740940 - DNA, 25 bp, Artificial sequence
  Synthetic oligonucleotide
gtgataatttcgtcgaggcgttaca

SEQ ID NO: 740941 - DNA, 25 bp, Artificial sequence
  Synthetic oligonucleotide
taggcttacgcgcatgagctctagg

SEQ ID NO: 740942 - DNA, 25 bp, Artificial sequence
  Synthetic oligonucleotide
ccgtcactatgttacgcttgacgta

SEQ ID NO: 740943 - DNA, 25 bp, Artificial sequence
  Synthetic oligonucleotide
gtcgatacgtcccattaagcgacgt

SEQ ID NO: 740944 - DNA, 25 bp, Artificial sequence
  Synthetic oligonucleotide
taggcttacgcgcatgagctctagg

SEQ ID NO: 740945 - DNA, 25 bp, Artificial sequence
  Synthetic oligonucleotide
gtgataatttcgtcgaggcgttaca

SEQ ID NO: 740946 - DNA, 25 bp, Artificial sequence
  Synthetic oligonucleotide
ttcgacgaggcgttacatattctga

SEQ ID NO: 740947 - DNA, 25 bp, Artificial sequence
  Synthetic oligonucleotide
ttcgacgaggcgatacatattctga

SEQ ID NO: 740948 - DNA, 25 bp, Artificial sequence
  Synthetic oligonucleotide
tatatcgtggacgcaaagtcgatac

SEQ ID NO: 740949 - DNA, 25 bp, Artificial sequence
  Synthetic oligonucleotide
gtgataatttcgacgaggcgttaca

SEQ ID NO: 740950 - DNA, 25 bp, Artificial sequence
  Synthetic oligonucleotide
gtcgatacgtccgattaagcgacgt

SEQ ID NO: 740951 - DNA, 25 bp, Artificial sequence
  Synthetic oligonucleotide
tataccctcgggatacgaattatgg

SEQ ID NO: 740952 - DNA, 25 bp, Artificial sequence
  Synthetic oligonucleotide
tataccctcgggttacgaattatgg

SEQ ID NO: 740953 - DNA, 25 bp, Artificial sequence
  Synthetic oligonucleotide
atggctgtgccttacgaatctggga

SEQ ID NO: 740954 - DNA, 25 bp, Artificial sequence
  Synthetic oligonucleotide
ttacgcgacattgtgcaaagttacg

SEQ ID NO: 740955 - DNA, 25 bp, Artificial sequence
  Synthetic oligonucleotide
tatatcgtggacccaaagtcgatac

SEQ ID NO: 740956 - DNA, 25 bp, Artificial sequence
  Synthetic oligonucleotide
taggcttacgcggatgagctctagg

SEQ ID NO: 740957 - DNA, 25 bp, Artificial sequence
  Synthetic oligonucleotide
atggctgtgcctaacgaatctggga

SEQ ID NO: 740958 - DNA, 25 bp, Artificial sequence
  Synthetic oligonucleotide
ttacgcgacattctgcaaagttacg

SEQ ID NO: 740959 - DNA, 25 bp, Artificial sequence
  Synthetic oligonucleotide
ggttacgatgacagctaagccatta

SEQ ID NO: 740960 - DNA, 25 bp, Artificial sequence
  Synthetic oligonucleotide
ggttacgatgactgctaagccatta

SEQ ID NO: 740961 - DNA, 25 bp, Artificial sequence
  Synthetic oligonucleotide
ccgtcactatgtaacgcttgacgta

SEQ ID NO: 740962 - DNA, 25 bp, Artificial sequence
  Synthetic oligonucleotide
ccgtcactatgttacgcttgacgta

SEQ ID NO: 740963 - DNA, 25 bp, Artificial sequence
  Synthetic oligonucleotide
ccgtcctattggatactattccgtg

SEQ ID NO: 740964 - DNA, 25 bp, Artificial sequence
  Synthetic oligonucleotide
ccgtcctattggttactattccgtg

SEQ ID NO: 740965 - DNA, 25 bp, Artificial sequence
  Synthetic oligonucleotide
ccacctagatcgaaattatcggaac

SEQ ID NO: 740966 - DNA, 25 bp, Artificial sequence
  Synthetic oligonucleotide
atactgagccgaatatcgtaagaca

SEQ ID NO: 740967 - DNA, 25 bp, Artificial sequence
  Synthetic oligonucleotide
atactgagccgattatcgtaagaca

SEQ ID NO: 740968 - DNA, 25 bp, Artificial sequence
  Synthetic oligonucleotide
tcttattagcgaggagcatttcgtg

SEQ ID NO: 740969 - DNA, 25 bp, Artificial sequence
  Synthetic oligonucleotide
tcttattagcgacgagcatttcgtg

SEQ ID NO: 740970 - DNA, 25 bp, Artificial sequence
  Synthetic oligonucleotide
agtctggtttcttattagcgaggag

SEQ ID NO: 740971 - DNA, 25 bp, Artificial sequence
  Synthetic oligonucleotide
agtctggtttctaattagcgaggag

SEQ ID NO: 740972 - DNA, 25 bp, Artificial sequence
  Synthetic oligonucleotide
gaactcgtcgcttatttacgaacct

SEQ ID NO: 740973 - DNA, 25 bp, Artificial sequence
  Synthetic oligonucleotide
gaactcgtcgctaatttacgaacct

SEQ ID NO: 740974 - DNA, 25 bp, Artificial sequence
  Synthetic oligonucleotide
aatatcgtaagagatccgcgagcga

SEQ ID NO: 740975 - DNA, 25 bp, Artificial sequence
  Synthetic oligonucleotide
aacgtatgccgcatattcggaacgt

SEQ ID NO: 740976 - DNA, 25 bp, Artificial sequence
  Synthetic oligonucleotide
aatatcgtaagacatccgcgagcga

SEQ ID NO: 740977 - DNA, 25 bp, Artificial sequence
  Synthetic oligonucleotide
gtatccgaagtcgtagtgataatat

SEQ ID NO: 740978 - DNA, 25 bp, Artificial sequence
  Synthetic oligonucleotide
gtatccgaagtcctagtgataatat

SEQ ID NO: 740979 - DNA, 25 bp, Artificial sequence
  Synthetic oligonucleotide
tatctaattcgtgagtcgggtacta

SEQ ID NO: 740980 - DNA, 25 bp, Artificial sequence
  Synthetic oligonucleotide
tatctaattcgtcagtcgggtacta

SEQ ID NO: 740981 - DNA, 25 bp, Artificial sequence
  Synthetic oligonucleotide
cataggtaacctattcgtgactagc

SEQ ID NO: 740982 - DNA, 25 bp, Artificial sequence
  Synthetic oligonucleotide
cataggtaaccttttcgtgactagc

SEQ ID NO: 740983 - DNA, 25 bp, Artificial sequence
  Synthetic oligonucleotide
atgacgcggagtgaacctgataacc

SEQ ID NO: 740984 - DNA, 25 bp, Artificial sequence
  Synthetic oligonucleotide
ccacctagatcgtaattatcggaac

SEQ ID NO: 740985 - DNA, 25 bp, Artificial sequence
  Synthetic oligonucleotide
atgacgcggagtcaacctgataacc

SEQ ID NO: 740986 - DNA, 25 bp, Artificial sequence
  Synthetic oligonucleotide
aacgtatgccgcttattcggaacgt

SEQ ID NO: 740987 - DNA, 25 bp, Artificial sequence
  Synthetic oligonucleotide
aacgtatgccgcatattcggaacgt

SEQ ID NO: 740988 - DNA, 25 bp, Artificial sequence
  Synthetic oligonucleotide
aatatcgtaagacatccgcgagcga

SEQ ID NO: 740989 - DNA, 25 bp, Artificial sequence
  Synthetic oligonucleotide
aatatcgtaagagatccgcgagcga

SEQ ID NO: 740990 - DNA, 25 bp, Artificial sequence
  Synthetic oligonucleotide
atactgagccgaatatcgtaagaca

SEQ ID NO: 740991 - DNA, 25 bp, Artificial sequence
  Synthetic oligonucleotide
atactgagccgattatcgtaagaca

SEQ ID NO: 740992 - DNA, 25 bp, Artificial sequence
  Synthetic oligonucleotide
tcttattagcgaggagcatttcgtg

SEQ ID NO: 740993 - DNA, 25 bp, Artificial sequence
  Synthetic oligonucleotide
tcttattagcgacgagcatttcgtg

SEQ ID NO: 740994 - DNA, 25 bp, Artificial sequence
  Synthetic oligonucleotide
agtctggtttcttattagcgaggag

SEQ ID NO: 740995 - DNA, 25 bp, Artificial sequence
  Synthetic oligonucleotide
agtctggtttctaattagcgaggag

SEQ ID NO: 740996 - DNA, 25 bp, Artificial sequence
  Synthetic oligonucleotide
ccacctagatcgaaattatcggaac

SEQ ID NO: 740997 - DNA, 25 bp, Artificial sequence
  Synthetic oligonucleotide
gaactcgtcgctaatttacgaacct

SEQ ID NO: 740998 - DNA, 25 bp, Artificial sequence
  Synthetic oligonucleotide
aacgtatgccgcttattcggaacgt

SEQ ID NO: 740999 - DNA, 25 bp, Artificial sequence
  Synthetic oligonucleotide
gtatccgaagtcgtagtgataatat

SEQ ID NO: 741000 - DNA, 25 bp, Artificial sequence
  Synthetic oligonucleotide
gtatccgaagtcctagtgataatat

SEQ ID NO: 741001 - DNA, 25 bp, Artificial sequence
  Synthetic oligonucleotide
tatctaattcgtgagtcgggtacta

SEQ ID NO: 741002 - DNA, 25 bp, Artificial sequence
  Synthetic oligonucleotide
tatctaattcgtcagtcgggtacta

SEQ ID NO: 741003 - DNA, 25 bp, Artificial sequence
  Synthetic oligonucleotide
cataggtaacctattcgtgactagc

SEQ ID NO: 741004 - DNA, 25 bp, Artificial sequence
  Synthetic oligonucleotide
cataggtaaccttttcgtgactagc

SEQ ID NO: 741005 - DNA, 25 bp, Artificial sequence
  Synthetic oligonucleotide
atgacgcggagtcaacctgataacc

SEQ ID NO: 741006 - DNA, 25 bp, Artificial sequence
  Synthetic oligonucleotide
atgacgcggagtgaacctgataacc

SEQ ID NO: 741007 - DNA, 25 bp, Artificial sequence
  Synthetic oligonucleotide
gaactcgtcgcttatttacgaacct

SEQ ID NO: 741008 - DNA, 25 bp, Artificial sequence
  Synthetic oligonucleotide
ccacctagatcgtaattatcggaac

SEQ ID NO: 741009 - DNA, 25 bp, Artificial sequence
  Synthetic oligonucleotide
tcgacctagcgtaaggatccacgat

SEQ ID NO: 741010 - DNA, 25 bp, Artificial sequence
  Synthetic oligonucleotide
tacggcggttgagttagttatgcga

SEQ ID NO: 741011 - DNA, 25 bp, Artificial sequence
  Synthetic oligonucleotide
caggcgatcacgatagatccactgc

SEQ ID NO: 741012 - DNA, 25 bp, Artificial sequence
  Synthetic oligonucleotide
caggcgatcacgttagatccactgc

SEQ ID NO: 741013 - DNA, 25 bp, Artificial sequence
  Synthetic oligonucleotide
acatgatcgatccgattacaggccg

SEQ ID NO: 741014 - DNA, 25 bp, Artificial sequence
  Synthetic oligonucleotide
acatgatcgatcggattacaggccg

SEQ ID NO: 741015 - DNA, 25 bp, Artificial sequence
  Synthetic oligonucleotide
gatccgattacacgccgatccatcg

SEQ ID NO: 741016 - DNA, 25 bp, Artificial sequence
  Synthetic oligonucleotide
gatccgattacaggccgatccatcg

SEQ ID NO: 741017 - DNA, 25 bp, Artificial sequence
  Synthetic oligonucleotide
tcgctggagatcgaatacgcccagc

SEQ ID NO: 741018 - DNA, 25 bp, Artificial sequence
  Synthetic oligonucleotide
tatacttacacagcaggcgatcacg

SEQ ID NO: 741019 - DNA, 25 bp, Artificial sequence
  Synthetic oligonucleotide
tcgacctagcgttaggatccacgat

SEQ ID NO: 741020 - DNA, 25 bp, Artificial sequence
  Synthetic oligonucleotide
accgagctgacgacgcgttagacag

SEQ ID NO: 741021 - DNA, 25 bp, Artificial sequence
  Synthetic oligonucleotide
tacggcggttgacttagttatgcga

SEQ ID NO: 741022 - DNA, 25 bp, Artificial sequence
  Synthetic oligonucleotide
tcgctggagatccaatacgcccagc

SEQ ID NO: 741023 - DNA, 25 bp, Artificial sequence
  Synthetic oligonucleotide
ggttgacttagttatgcgaggttcg

SEQ ID NO: 741024 - DNA, 25 bp, Artificial sequence
  Synthetic oligonucleotide
tatacttacacaccaggcgatcacg

SEQ ID NO: 741025 - DNA, 25 bp, Artificial sequence
  Synthetic oligonucleotide
accgagctgacgtcgcgttagacag

SEQ ID NO: 741026 - DNA, 25 bp, Artificial sequence
  Synthetic oligonucleotide
gtcacgtttaggtctatgtcgaagc

SEQ ID NO: 741027 - DNA, 25 bp, Artificial sequence
  Synthetic oligonucleotide
gtcacgtttaggactatgtcgaagc

SEQ ID NO: 741028 - DNA, 25 bp, Artificial sequence
  Synthetic oligonucleotide
cgaccatgtcgtgtagcttaatacc

SEQ ID NO: 741029 - DNA, 25 bp, Artificial sequence
  Synthetic oligonucleotide
cgaccatgtcgtctagcttaatacc

SEQ ID NO: 741030 - DNA, 25 bp, Artificial sequence
  Synthetic oligonucleotide
ggttgacttagtaatgcgaggttcg

SEQ ID NO: 741031 - DNA, 25 bp, Artificial sequence
  Synthetic oligonucleotide
gtcacgtttaggtctatgtcgaagc

SEQ ID NO: 741032 - DNA, 25 bp, Artificial sequence
  Synthetic oligonucleotide
cgaccatgtcgtctagcttaatacc

SEQ ID NO: 741033 - DNA, 25 bp, Artificial sequence
  Synthetic oligonucleotide
tatacttacacagcaggcgatcacg

SEQ ID NO: 741034 - DNA, 25 bp, Artificial sequence
  Synthetic oligonucleotide
cgaccatgtcgtgtagcttaatacc

SEQ ID NO: 741035 - DNA, 25 bp, Artificial sequence
  Synthetic oligonucleotide
gtcacgtttaggactatgtcgaagc

SEQ ID NO: 741036 - DNA, 25 bp, Artificial sequence
  Synthetic oligonucleotide
gatccgattacacgccgatccatcg

SEQ ID NO: 741037 - DNA, 25 bp, Artificial sequence
  Synthetic oligonucleotide
tatacttacacaccaggcgatcacg

SEQ ID NO: 741038 - DNA, 25 bp, Artificial sequence
  Synthetic oligonucleotide
accgagctgacgtcgcgttagacag

SEQ ID NO: 741039 - DNA, 25 bp, Artificial sequence
  Synthetic oligonucleotide
tcgacctagcgtaaggatccacgat

SEQ ID NO: 741040 - DNA, 25 bp, Artificial sequence
  Synthetic oligonucleotide
tcgacctagcgttaggatccacgat

SEQ ID NO: 741041 - DNA, 25 bp, Artificial sequence
  Synthetic oligonucleotide
tcgctggagatccaatacgcccagc

SEQ ID NO: 741042 - DNA, 25 bp, Artificial sequence
  Synthetic oligonucleotide
gatccgattacaggccgatccatcg

SEQ ID NO: 741043 - DNA, 25 bp, Artificial sequence
  Synthetic oligonucleotide
acatgatcgatcggattacaggccg

SEQ ID NO: 741044 - DNA, 25 bp, Artificial sequence
  Synthetic oligonucleotide
acatgatcgatccgattacaggccg

SEQ ID NO: 741045 - DNA, 25 bp, Artificial sequence
  Synthetic oligonucleotide
ggttgacttagtaatgcgaggttcg

SEQ ID NO: 741046 - DNA, 25 bp, Artificial sequence
  Synthetic oligonucleotide
accgagctgacgacgcgttagacag

SEQ ID NO: 741047 - DNA, 25 bp, Artificial sequence
  Synthetic oligonucleotide
tcgctggagatcgaatacgcccagc

SEQ ID NO: 741048 - DNA, 25 bp, Artificial sequence
  Synthetic oligonucleotide
ggttgacttagttatgcgaggttcg

SEQ ID NO: 741049 - DNA, 25 bp, Artificial sequence
  Synthetic oligonucleotide
caggcgatcacgttagatccactgc

SEQ ID NO: 741050 - DNA, 25 bp, Artificial sequence
  Synthetic oligonucleotide
tacggcggttgacttagttatgcga

SEQ ID NO: 741051 - DNA, 25 bp, Artificial sequence
  Synthetic oligonucleotide
tacggcggttgagttagttatgcga

SEQ ID NO: 741052 - DNA, 25 bp, Artificial sequence
  Synthetic oligonucleotide
caggcgatcacgatagatccactgc

SEQ ID NO: 741053 - DNA, 25 bp, Artificial sequence
  Synthetic oligonucleotide
gacgacaataattcggcggtgcctc

SEQ ID NO: 741054 - DNA, 25 bp, Artificial sequence
  Synthetic oligonucleotide
attagaccggatgacccggacatgg

SEQ ID NO: 741055 - DNA, 25 bp, Artificial sequence
  Synthetic oligonucleotide
cgtgacgactgcatagtggtcggtc

SEQ ID NO: 741056 - DNA, 25 bp, Artificial sequence
  Synthetic oligonucleotide
attagaccggatcacccggacatgg

SEQ ID NO: 741057 - DNA, 25 bp, Artificial sequence
  Synthetic oligonucleotide
gacatggacgttaagtatccggcct

SEQ ID NO: 741058 - DNA, 25 bp, Artificial sequence
  Synthetic oligonucleotide
cggcctggacgacaataattcggcg

SEQ ID NO: 741059 - DNA, 25 bp, Artificial sequence
  Synthetic oligonucleotide
cggcctggacgagaataattcggcg

SEQ ID NO: 741060 - DNA, 25 bp, Artificial sequence
  Synthetic oligonucleotide
ggcctggacgacaataattcggcgg

SEQ ID NO: 741061 - DNA, 25 bp, Artificial sequence
  Synthetic oligonucleotide
ggcctggacgactataattcggcgg

SEQ ID NO: 741062 - DNA, 25 bp, Artificial sequence
  Synthetic oligonucleotide
gacgacaataatacggcggtgcctc

SEQ ID NO: 741063 - DNA, 25 bp, Artificial sequence
  Synthetic oligonucleotide
gacatggacgtttagtatccggcct

SEQ ID NO: 741064 - DNA, 25 bp, Artificial sequence
  Synthetic oligonucleotide
tcacaatattcccagaactctgcat

SEQ ID NO: 741065 - DNA, 25 bp, Artificial sequence
  Synthetic oligonucleotide
tcacaatattccgagaactctgcat

SEQ ID NO: 741066 - DNA, 25 bp, Artificial sequence
  Synthetic oligonucleotide
gtacatgagtcaaagtccgaatagc

SEQ ID NO: 741067 - DNA, 25 bp, Artificial sequence
  Synthetic oligonucleotide
gtacatgagtcatagtccgaatagc

SEQ ID NO: 741068 - DNA, 25 bp, Artificial sequence
  Synthetic oligonucleotide
tcgcctgttacttggttagacagtc

SEQ ID NO: 741069 - DNA, 25 bp, Artificial sequence
  Synthetic oligonucleotide
tcgcctgttactaggttagacagtc

SEQ ID NO: 741070 - DNA, 25 bp, Artificial sequence
  Synthetic oligonucleotide
ggttagactgatggtcaacgaccta

SEQ ID NO: 741071 - DNA, 25 bp, Artificial sequence
  Synthetic oligonucleotide
cgtgacgactgcttagtggtcggtc

SEQ ID NO: 741072 - DNA, 25 bp, Artificial sequence
  Synthetic oligonucleotide
ctagttatggcgacggattagaccg

SEQ ID NO: 741073 - DNA, 25 bp, Artificial sequence
  Synthetic oligonucleotide
ctagttatggcgtcggattagaccg

SEQ ID NO: 741074 - DNA, 25 bp, Artificial sequence
  Synthetic oligonucleotide
ggttagactgatcgtcaacgaccta

SEQ ID NO: 741075 - DNA, 25 bp, Artificial sequence
  Synthetic oligonucleotide
attagaccggatgacccggacatgg

SEQ ID NO: 741076 - DNA, 25 bp, Artificial sequence
  Synthetic oligonucleotide
cgtgacgactgcatagtggtcggtc

SEQ ID NO: 741077 - DNA, 25 bp, Artificial sequence
  Synthetic oligonucleotide
ctagttatggcgtcggattagaccg

SEQ ID NO: 741078 - DNA, 25 bp, Artificial sequence
  Synthetic oligonucleotide
attagaccggatcacccggacatgg

SEQ ID NO: 741079 - DNA, 25 bp, Artificial sequence
  Synthetic oligonucleotide
gacatggacgttaagtatccggcct

SEQ ID NO: 741080 - DNA, 25 bp, Artificial sequence
  Synthetic oligonucleotide
gacatggacgtttagtatccggcct

SEQ ID NO: 741081 - DNA, 25 bp, Artificial sequence
  Synthetic oligonucleotide
cggcctggacgagaataattcggcg

SEQ ID NO: 741082 - DNA, 25 bp, Artificial sequence
  Synthetic oligonucleotide
cggcctggacgacaataattcggcg

SEQ ID NO: 741083 - DNA, 25 bp, Artificial sequence
  Synthetic oligonucleotide
ggcctggacgacaataattcggcgg

SEQ ID NO: 741084 - DNA, 25 bp, Artificial sequence
  Synthetic oligonucleotide
ggcctggacgactataattcggcgg

SEQ ID NO: 741085 - DNA, 25 bp, Artificial sequence
  Synthetic oligonucleotide
gacgacaataatacggcggtgcctc

SEQ ID NO: 741086 - DNA, 25 bp, Artificial sequence
  Synthetic oligonucleotide
cgtgacgactgcttagtggtcggtc

SEQ ID NO: 741087 - DNA, 25 bp, Artificial sequence
  Synthetic oligonucleotide
gacgacaataattcggcggtgcctc

SEQ ID NO: 741088 - DNA, 25 bp, Artificial sequence
  Synthetic oligonucleotide
ctagttatggcgacggattagaccg

SEQ ID NO: 741089 - DNA, 25 bp, Artificial sequence
  Synthetic oligonucleotide
ggttagactgatcgtcaacgaccta

SEQ ID NO: 741090 - DNA, 25 bp, Artificial sequence
  Synthetic oligonucleotide
ggttagactgatggtcaacgaccta

SEQ ID NO: 741091 - DNA, 25 bp, Artificial sequence
  Synthetic oligonucleotide
tcgcctgttacttggttagacagtc

SEQ ID NO: 741092 - DNA, 25 bp, Artificial sequence
  Synthetic oligonucleotide
tcgcctgttactaggttagacagtc

SEQ ID NO: 741093 - DNA, 25 bp, Artificial sequence
  Synthetic oligonucleotide
gtacatgagtcaaagtccgaatagc

SEQ ID NO: 741094 - DNA, 25 bp, Artificial sequence
  Synthetic oligonucleotide
gtacatgagtcatagtccgaatagc

SEQ ID NO: 741095 - DNA, 25 bp, Artificial sequence
  Synthetic oligonucleotide
tcacaatattccgagaactctgcat

SEQ ID NO: 741096 - DNA, 25 bp, Artificial sequence
  Synthetic oligonucleotide
tcacaatattcccagaactctgcat

SEQ ID NO: 741097 - DNA, 25 bp, Artificial sequence
  Synthetic oligonucleotide
tcttatcgctgattgtctaggattc

SEQ ID NO: 741098 - DNA, 25 bp, Artificial sequence
  Synthetic oligonucleotide
ccgaccatatatgggtcttgctgat

SEQ ID NO: 741099 - DNA, 25 bp, Artificial sequence
  Synthetic oligonucleotide
tcgaatgtgtaaacgtcaactcgta

SEQ ID NO: 741100 - DNA, 25 bp, Artificial sequence
  Synthetic oligonucleotide
gtgaagtgctaggctagtattgaca

SEQ ID NO: 741101 - DNA, 25 bp, Artificial sequence
  Synthetic oligonucleotide
gtgaagtgctagcctagtattgaca

SEQ ID NO: 741102 - DNA, 25 bp, Artificial sequence
  Synthetic oligonucleotide
ctaggctagtatagacatctacggg

SEQ ID NO: 741103 - DNA, 25 bp, Artificial sequence
  Synthetic oligonucleotide
ctaggctagtattgacatctacggg

SEQ ID NO: 741104 - DNA, 25 bp, Artificial sequence
  Synthetic oligonucleotide
ggctagtattgacatctacgggcgg

SEQ ID NO: 741105 - DNA, 25 bp, Artificial sequence
  Synthetic oligonucleotide
ggctagtattgagatctacgggcgg

SEQ ID NO: 741106 - DNA, 25 bp, Artificial sequence
  Synthetic oligonucleotide
tcgaatgtgtaatcgtcaactcgta

SEQ ID NO: 741107 - DNA, 25 bp, Artificial sequence
  Synthetic oligonucleotide
ccgaccatatatcggtcttgctgat

SEQ ID NO: 741108 - DNA, 25 bp, Artificial sequence
  Synthetic oligonucleotide
actggtccacatatagacatacttc

SEQ ID NO: 741109 - DNA, 25 bp, Artificial sequence
  Synthetic oligonucleotide
actggtccacatttagacatacttc

SEQ ID NO: 741110 - DNA, 25 bp, Artificial sequence
  Synthetic oligonucleotide
cctgaggatttattcacctgactcg

SEQ ID NO: 741111 - DNA, 25 bp, Artificial sequence
  Synthetic oligonucleotide
agcgtgctcctacatagcacgagcg

SEQ ID NO: 741112 - DNA, 25 bp, Artificial sequence
  Synthetic oligonucleotide
tcttatcgctgaatgtctaggattc

SEQ ID NO: 741113 - DNA, 25 bp, Artificial sequence
  Synthetic oligonucleotide
gattctcgtcaatgatctacgatcc

SEQ ID NO: 741114 - DNA, 25 bp, Artificial sequence
  Synthetic oligonucleotide
gattctcgtcaaagatctacgatcc

SEQ ID NO: 741115 - DNA, 25 bp, Artificial sequence
  Synthetic oligonucleotide
atgagactactcagtactagatggt

SEQ ID NO: 741116 - DNA, 25 bp, Artificial sequence
  Synthetic oligonucleotide
atgagactactctgtactagatggt

SEQ ID NO: 741117 - DNA, 25 bp, Artificial sequence
  Synthetic oligonucleotide
agcgtgctcctagatagcacgagcg

SEQ ID NO: 741118 - DNA, 25 bp, Artificial sequence
  Synthetic oligonucleotide
cctgaggatttaatcacctgactcg

SEQ ID NO: 741119 - DNA, 25 bp, Artificial sequence
  Synthetic oligonucleotide
cctgaggatttaatcacctgactcg

SEQ ID NO: 741120 - DNA, 25 bp, Artificial sequence
  Synthetic oligonucleotide
atgagactactctgtactagatggt

SEQ ID NO: 741121 - DNA, 25 bp, Artificial sequence
  Synthetic oligonucleotide
atgagactactcagtactagatggt

SEQ ID NO: 741122 - DNA, 25 bp, Artificial sequence
  Synthetic oligonucleotide
tcgaatgtgtaaacgtcaactcgta

SEQ ID NO: 741123 - DNA, 25 bp, Artificial sequence
  Synthetic oligonucleotide
tcgaatgtgtaatcgtcaactcgta

SEQ ID NO: 741124 - DNA, 25 bp, Artificial sequence
  Synthetic oligonucleotide
gtgaagtgctaggctagtattgaca

SEQ ID NO: 741125 - DNA, 25 bp, Artificial sequence
  Synthetic oligonucleotide
gtgaagtgctagcctagtattgaca

SEQ ID NO: 741126 - DNA, 25 bp, Artificial sequence
  Synthetic oligonucleotide
ctaggctagtatagacatctacggg

SEQ ID NO: 741127 - DNA, 25 bp, Artificial sequence
  Synthetic oligonucleotide
ctaggctagtattgacatctacggg

SEQ ID NO: 741128 - DNA, 25 bp, Artificial sequence
  Synthetic oligonucleotide
ggctagtattgagatctacgggcgg

SEQ ID NO: 741129 - DNA, 25 bp, Artificial sequence
  Synthetic oligonucleotide
ggctagtattgacatctacgggcgg

SEQ ID NO: 741130 - DNA, 25 bp, Artificial sequence
  Synthetic oligonucleotide
gattctcgtcaatgatctacgatcc

SEQ ID NO: 741131 - DNA, 25 bp, Artificial sequence
  Synthetic oligonucleotide
ccgaccatatatcggtcttgctgat

SEQ ID NO: 741132 - DNA, 25 bp, Artificial sequence
  Synthetic oligonucleotide
cctgaggatttattcacctgactcg

SEQ ID NO: 741133 - DNA, 25 bp, Artificial sequence
  Synthetic oligonucleotide
gattctcgtcaaagatctacgatcc

SEQ ID NO: 741134 - DNA, 25 bp, Artificial sequence
  Synthetic oligonucleotide
tcttatcgctgaatgtctaggattc

SEQ ID NO: 741135 - DNA, 25 bp, Artificial sequence
  Synthetic oligonucleotide
tcttatcgctgattgtctaggattc

SEQ ID NO: 741136 - DNA, 25 bp, Artificial sequence
  Synthetic oligonucleotide
ccgaccatatatgggtcttgctgat

SEQ ID NO: 741137 - DNA, 25 bp, Artificial sequence
  Synthetic oligonucleotide
agcgtgctcctagatagcacgagcg

SEQ ID NO: 741138 - DNA, 25 bp, Artificial sequence
  Synthetic oligonucleotide
actggtccacatatagacatacttc

SEQ ID NO: 741139 - DNA, 25 bp, Artificial sequence
  Synthetic oligonucleotide
actggtccacatttagacatacttc

SEQ ID NO: 741140 - DNA, 25 bp, Artificial sequence
  Synthetic oligonucleotide
agcgtgctcctacatagcacgagcg

SEQ ID NO: 741141 - DNA, 25 bp, Artificial sequence
  Synthetic oligonucleotide
atcgctcctcgaaatgtacggatag

SEQ ID NO: 741142 - DNA, 25 bp, Artificial sequence
  Synthetic oligonucleotide
atcgctcctcgatatgtacggatag

SEQ ID NO: 741143 - DNA, 25 bp, Artificial sequence
  Synthetic oligonucleotide
catatagccatcaaagcgctcgata

SEQ ID NO: 741144 - DNA, 25 bp, Artificial sequence
  Synthetic oligonucleotide
catatagccatctaagcgctcgata

SEQ ID NO: 741145 - DNA, 25 bp, Artificial sequence
  Synthetic oligonucleotide
cgctatctcgtatggggtccgtctg

SEQ ID NO: 741146 - DNA, 25 bp, Artificial sequence
  Synthetic oligonucleotide
tcaggtcatatgtcgcgggttctgc

SEQ ID NO: 741147 - DNA, 25 bp, Artificial sequence
  Synthetic oligonucleotide
tcaggtcatatgacgcgggttctgc

SEQ ID NO: 741148 - DNA, 25 bp, Artificial sequence
  Synthetic oligonucleotide
gtacggataggcgacggcatgtacg

SEQ ID NO: 741149 - DNA, 25 bp, Artificial sequence
  Synthetic oligonucleotide
gacactgatctgtgagtcgcttaaa

SEQ ID NO: 741150 - DNA, 25 bp, Artificial sequence
  Synthetic oligonucleotide
aggcaatgtgtcggaacggcgagct

SEQ ID NO: 741151 - DNA, 25 bp, Artificial sequence
  Synthetic oligonucleotide
cgctatctcgtaaggggtccgtctg

SEQ ID NO: 741152 - DNA, 25 bp, Artificial sequence
  Synthetic oligonucleotide
gtacggataggccacggcatgtacg

SEQ ID NO: 741153 - DNA, 25 bp, Artificial sequence
  Synthetic oligonucleotide
ataggccacggcatgtacgagcata

SEQ ID NO: 741154 - DNA, 25 bp, Artificial sequence
  Synthetic oligonucleotide
ataggccacggcttgtacgagcata

SEQ ID NO: 741155 - DNA, 25 bp, Artificial sequence
  Synthetic oligonucleotide
gcataagccgaagtgcacgagcata

SEQ ID NO: 741156 - DNA, 25 bp, Artificial sequence
  Synthetic oligonucleotide
tcttagagcttaacgccatgtctgt

SEQ ID NO: 741157 - DNA, 25 bp, Artificial sequence
  Synthetic oligonucleotide
gacactgatctgagagtcgcttaaa

SEQ ID NO: 741158 - DNA, 25 bp, Artificial sequence
  Synthetic oligonucleotide
cgcttaaatcatctgcgtgtcttag

SEQ ID NO: 741159 - DNA, 25 bp, Artificial sequence
  Synthetic oligonucleotide
cgcttaaatcatgtgcgtgtcttag

SEQ ID NO: 741160 - DNA, 25 bp, Artificial sequence
  Synthetic oligonucleotide
tcttagagcttatcgccatgtctgt

SEQ ID NO: 741161 - DNA, 25 bp, Artificial sequence
  Synthetic oligonucleotide
aggcaatgtgtccgaacggcgagct

SEQ ID NO: 741162 - DNA, 25 bp, Artificial sequence
  Synthetic oligonucleotide
gcataagccgaactgcacgagcata

SEQ ID NO: 741163 - DNA, 25 bp, Artificial sequence
  Synthetic oligonucleotide
gtacggataggcgacggcatgtacg

SEQ ID NO: 741164 - DNA, 25 bp, Artificial sequence
  Synthetic oligonucleotide
tcaggtcatatgacgcgggttctgc

SEQ ID NO: 741165 - DNA, 25 bp, Artificial sequence
  Synthetic oligonucleotide
aggcaatgtgtccgaacggcgagct

SEQ ID NO: 741166 - DNA, 25 bp, Artificial sequence
  Synthetic oligonucleotide
tcttagagcttatcgccatgtctgt

SEQ ID NO: 741167 - DNA, 25 bp, Artificial sequence
  Synthetic oligonucleotide
gtacggataggccacggcatgtacg

SEQ ID NO: 741168 - DNA, 25 bp, Artificial sequence
  Synthetic oligonucleotide
atcgctcctcgatatgtacggatag

SEQ ID NO: 741169 - DNA, 25 bp, Artificial sequence
  Synthetic oligonucleotide
cgctatctcgtaaggggtccgtctg

SEQ ID NO: 741170 - DNA, 25 bp, Artificial sequence
  Synthetic oligonucleotide
atcgctcctcgaaatgtacggatag

SEQ ID NO: 741171 - DNA, 25 bp, Artificial sequence
  Synthetic oligonucleotide
aggcaatgtgtcggaacggcgagct

SEQ ID NO: 741172 - DNA, 25 bp, Artificial sequence
  Synthetic oligonucleotide
catatagccatctaagcgctcgata

SEQ ID NO: 741173 - DNA, 25 bp, Artificial sequence
  Synthetic oligonucleotide
tcaggtcatatgtcgcgggttctgc

SEQ ID NO: 741174 - DNA, 25 bp, Artificial sequence
  Synthetic oligonucleotide
cgctatctcgtatggggtccgtctg

SEQ ID NO: 741175 - DNA, 25 bp, Artificial sequence
  Synthetic oligonucleotide
ataggccacggcttgtacgagcata

SEQ ID NO: 741176 - DNA, 25 bp, Artificial sequence
  Synthetic oligonucleotide
ataggccacggcatgtacgagcata

SEQ ID NO: 741177 - DNA, 25 bp, Artificial sequence
  Synthetic oligonucleotide
gcataagccgaactgcacgagcata

SEQ ID NO: 741178 - DNA, 25 bp, Artificial sequence
  Synthetic oligonucleotide
gcataagccgaagtgcacgagcata

SEQ ID NO: 741179 - DNA, 25 bp, Artificial sequence
  Synthetic oligonucleotide
gacactgatctgagagtcgcttaaa

SEQ ID NO: 741180 - DNA, 25 bp, Artificial sequence
  Synthetic oligonucleotide
gacactgatctgtgagtcgcttaaa

SEQ ID NO: 741181 - DNA, 25 bp, Artificial sequence
  Synthetic oligonucleotide
cgcttaaatcatctgcgtgtcttag

SEQ ID NO: 741182 - DNA, 25 bp, Artificial sequence
  Synthetic oligonucleotide
cgcttaaatcatgtgcgtgtcttag

SEQ ID NO: 741183 - DNA, 25 bp, Artificial sequence
  Synthetic oligonucleotide
tcttagagcttaacgccatgtctgt

SEQ ID NO: 741184 - DNA, 25 bp, Artificial sequence
  Synthetic oligonucleotide
catatagccatcaaagcgctcgata

SEQ ID NO: 741185 - DNA, 25 bp, Artificial sequence
  Synthetic oligonucleotide
ctaacgacgctggtagcagtctatc

SEQ ID NO: 741186 - DNA, 25 bp, Artificial sequence
  Synthetic oligonucleotide
gatcgctagtaccagttagagatgc

SEQ ID NO: 741187 - DNA, 25 bp, Artificial sequence
  Synthetic oligonucleotide
gcagtctatcagatcgctagtacga

SEQ ID NO: 741188 - DNA, 25 bp, Artificial sequence
  Synthetic oligonucleotide
ctaacgacgctgctagcagtctatc

SEQ ID NO: 741189 - DNA, 25 bp, Artificial sequence
  Synthetic oligonucleotide
tacggtataacaaggcgtgctacgg

SEQ ID NO: 741190 - DNA, 25 bp, Artificial sequence
  Synthetic oligonucleotide
tacggtataacatggcgtgctacgg

SEQ ID NO: 741191 - DNA, 25 bp, Artificial sequence
  Synthetic oligonucleotide
tggtgttcgatagccggatcgggtt

SEQ ID NO: 741192 - DNA, 25 bp, Artificial sequence
  Synthetic oligonucleotide
gcagtctatcagttcgctagtacga

SEQ ID NO: 741193 - DNA, 25 bp, Artificial sequence
  Synthetic oligonucleotide
tggtgttcgatacccggatcgggtt

SEQ ID NO: 741194 - DNA, 25 bp, Artificial sequence
  Synthetic oligonucleotide
cgctcagtatgaaccatgagcgccg

SEQ ID NO: 741195 - DNA, 25 bp, Artificial sequence
  Synthetic oligonucleotide
gatcgctagtacgagttagagatgc

SEQ ID NO: 741196 - DNA, 25 bp, Artificial sequence
  Synthetic oligonucleotide
cgctcagtatgatccatgagcgccg

SEQ ID NO: 741197 - DNA, 25 bp, Artificial sequence
  Synthetic oligonucleotide
tcacatgatacaacgctctaaatca

SEQ ID NO: 741198 - DNA, 25 bp, Artificial sequence
  Synthetic oligonucleotide
tcacatgatacatcgctctaaatca

SEQ ID NO: 741199 - DNA, 25 bp, Artificial sequence
  Synthetic oligonucleotide
gctctaaatcatgatgcgacagtct

SEQ ID NO: 741200 - DNA, 25 bp, Artificial sequence
  Synthetic oligonucleotide
gctctaaatcatcatgcgacagtct

SEQ ID NO: 741201 - DNA, 25 bp, Artificial sequence
  Synthetic oligonucleotide
catgctcgactcagagacactgatc

SEQ ID NO: 741202 - DNA, 25 bp, Artificial sequence
  Synthetic oligonucleotide
catgctcgactctgagacactgatc

SEQ ID NO: 741203 - DNA, 25 bp, Artificial sequence
  Synthetic oligonucleotide
tctgagacactgttcgagcattaag

SEQ ID NO: 741204 - DNA, 25 bp, Artificial sequence
  Synthetic oligonucleotide
tctgagacactgatcgagcattaag

SEQ ID NO: 741205 - DNA, 25 bp, Artificial sequence
  Synthetic oligonucleotide
gcactcgcgtaaagacgctgcatcg

SEQ ID NO: 741206 - DNA, 25 bp, Artificial sequence
  Synthetic oligonucleotide
gcactcgcgtaatgacgctgcatcg

SEQ ID NO: 741207 - DNA, 25 bp, Artificial sequence
  Synthetic oligonucleotide
gcagtctatcagttcgctagtacga

SEQ ID NO: 741208 - DNA, 25 bp, Artificial sequence
  Synthetic oligonucleotide
gatcgctagtaccagttagagatgc

SEQ ID NO: 741209 - DNA, 25 bp, Artificial sequence
  Synthetic oligonucleotide
tggtgttcgatacccggatcgggtt

SEQ ID NO: 741210 - DNA, 25 bp, Artificial sequence
  Synthetic oligonucleotide
tacggtataacatggcgtgctacgg

SEQ ID NO: 741211 - DNA, 25 bp, Artificial sequence
  Synthetic oligonucleotide
tacggtataacaaggcgtgctacgg

SEQ ID NO: 741212 - DNA, 25 bp, Artificial sequence
  Synthetic oligonucleotide
ctaacgacgctggtagcagtctatc

SEQ ID NO: 741213 - DNA, 25 bp, Artificial sequence
  Synthetic oligonucleotide
tggtgttcgatagccggatcgggtt

SEQ ID NO: 741214 - DNA, 25 bp, Artificial sequence
  Synthetic oligonucleotide
gcagtctatcagatcgctagtacga

SEQ ID NO: 741215 - DNA, 25 bp, Artificial sequence
  Synthetic oligonucleotide
gatcgctagtacgagttagagatgc

SEQ ID NO: 741216 - DNA, 25 bp, Artificial sequence
  Synthetic oligonucleotide
tctgagacactgatcgagcattaag

SEQ ID NO: 741217 - DNA, 25 bp, Artificial sequence
  Synthetic oligonucleotide
tcacatgatacatcgctctaaatca

SEQ ID NO: 741218 - DNA, 25 bp, Artificial sequence
  Synthetic oligonucleotide
gcactcgcgtaatgacgctgcatcg

SEQ ID NO: 741219 - DNA, 25 bp, Artificial sequence
  Synthetic oligonucleotide
ctaacgacgctgctagcagtctatc

SEQ ID NO: 741220 - DNA, 25 bp, Artificial sequence
  Synthetic oligonucleotide
tctgagacactgttcgagcattaag

SEQ ID NO: 741221 - DNA, 25 bp, Artificial sequence
  Synthetic oligonucleotide
cgctcagtatgaaccatgagcgccg

SEQ ID NO: 741222 - DNA, 25 bp, Artificial sequence
  Synthetic oligonucleotide
gcactcgcgtaaagacgctgcatcg

SEQ ID NO: 741223 - DNA, 25 bp, Artificial sequence
  Synthetic oligonucleotide
tcacatgatacaacgctctaaatca

SEQ ID NO: 741224 - DNA, 25 bp, Artificial sequence
  Synthetic oligonucleotide
gctctaaatcatgatgcgacagtct

SEQ ID NO: 741225 - DNA, 25 bp, Artificial sequence
  Synthetic oligonucleotide
gctctaaatcatcatgcgacagtct

SEQ ID NO: 741226 - DNA, 25 bp, Artificial sequence
  Synthetic oligonucleotide
catgctcgactctgagacactgatc

SEQ ID NO: 741227 - DNA, 25 bp, Artificial sequence
  Synthetic oligonucleotide
catgctcgactcagagacactgatc

SEQ ID NO: 741228 - DNA, 25 bp, Artificial sequence
  Synthetic oligonucleotide
cgctcagtatgatccatgagcgccg

SEQ ID NO: 741229 - DNA, 25 bp, Artificial sequence
  Synthetic oligonucleotide
ccaattcaagattagtccagctcgt

SEQ ID NO: 741230 - DNA, 25 bp, Artificial sequence
  Synthetic oligonucleotide
tacgagatgagcaacgtaactacag

SEQ ID NO: 741231 - DNA, 25 bp, Artificial sequence
  Synthetic oligonucleotide
actcgttgatagacaaccaagctcg

SEQ ID NO: 741232 - DNA, 25 bp, Artificial sequence
  Synthetic oligonucleotide
actcgttgatagtcaaccaagctcg

SEQ ID NO: 741233 - DNA, 25 bp, Artificial sequence
  Synthetic oligonucleotide
tacgagatgagctacgtaactacag

SEQ ID NO: 741234 - DNA, 25 bp, Artificial sequence
  Synthetic oligonucleotide
atgagctacgtaactacagtgatag

SEQ ID NO: 741235 - DNA, 25 bp, Artificial sequence
  Synthetic oligonucleotide
atgagctacgtatctacagtgatag

SEQ ID NO: 741236 - DNA, 25 bp, Artificial sequence
  Synthetic oligonucleotide
ctacagtgataggatatagggtacg

SEQ ID NO: 741237 - DNA, 25 bp, Artificial sequence
  Synthetic oligonucleotide
ccaattcaagataagtccagctcgt

SEQ ID NO: 741238 - DNA, 25 bp, Artificial sequence
  Synthetic oligonucleotide
ctacagtgatagcatatagggtacg

SEQ ID NO: 741239 - DNA, 25 bp, Artificial sequence
  Synthetic oligonucleotide
gggcacgttgtttaactgttgccgc

SEQ ID NO: 741240 - DNA, 25 bp, Artificial sequence
  Synthetic oligonucleotide
gggcacgttgttaaactgttgccgc

SEQ ID NO: 741241 - DNA, 25 bp, Artificial sequence
  Synthetic oligonucleotide
gatacttcgataccgttgtgaatag

SEQ ID NO: 741242 - DNA, 25 bp, Artificial sequence
  Synthetic oligonucleotide
gatacttcgatagcgttgtgaatag

SEQ ID NO: 741243 - DNA, 25 bp, Artificial sequence
  Synthetic oligonucleotide
agtcatcgtgagaagtatgaacgtg

SEQ ID NO: 741244 - DNA, 25 bp, Artificial sequence
  Synthetic oligonucleotide
agtcatcgtgagtagtatgaacgtg

SEQ ID NO: 741245 - DNA, 25 bp, Artificial sequence
  Synthetic oligonucleotide
atgtactatggaccggtcaatgtca

SEQ ID NO: 741246 - DNA, 25 bp, Artificial sequence
  Synthetic oligonucleotide
aggtcgtagtcgtattagtcaggtt

SEQ ID NO: 741247 - DNA, 25 bp, Artificial sequence
  Synthetic oligonucleotide
aggtcgtagtcgaattagtcaggtt

SEQ ID NO: 741248 - DNA, 25 bp, Artificial sequence
  Synthetic oligonucleotide
actagttgacttcgagtatgccatg

SEQ ID NO: 741249 - DNA, 25 bp, Artificial sequence
  Synthetic oligonucleotide
atgtactatggagcggtcaatgtca

SEQ ID NO: 741250 - DNA, 25 bp, Artificial sequence
  Synthetic oligonucleotide
actagttgacttggagtatgccatg

SEQ ID NO: 741251 - DNA, 25 bp, Artificial sequence
  Synthetic oligonucleotide
ctacagtgatagcatatagggtacg

SEQ ID NO: 741252 - DNA, 25 bp, Artificial sequence
  Synthetic oligonucleotide
actagttgacttggagtatgccatg

SEQ ID NO: 741253 - DNA, 25 bp, Artificial sequence
  Synthetic oligonucleotide
ccaattcaagataagtccagctcgt

SEQ ID NO: 741254 - DNA, 25 bp, Artificial sequence
  Synthetic oligonucleotide
aggtcgtagtcgtattagtcaggtt

SEQ ID NO: 741255 - DNA, 25 bp, Artificial sequence
  Synthetic oligonucleotide
aggtcgtagtcgaattagtcaggtt

SEQ ID NO: 741256 - DNA, 25 bp, Artificial sequence
  Synthetic oligonucleotide
actagttgacttcgagtatgccatg

SEQ ID NO: 741257 - DNA, 25 bp, Artificial sequence
  Synthetic oligonucleotide
gatacttcgatagcgttgtgaatag

SEQ ID NO: 741258 - DNA, 25 bp, Artificial sequence
  Synthetic oligonucleotide
ctacagtgataggatatagggtacg

SEQ ID NO: 741259 - DNA, 25 bp, Artificial sequence
  Synthetic oligonucleotide
atgtactatggagcggtcaatgtca

SEQ ID NO: 741260 - DNA, 25 bp, Artificial sequence
  Synthetic oligonucleotide
atgtactatggaccggtcaatgtca

SEQ ID NO: 741261 - DNA, 25 bp, Artificial sequence
  Synthetic oligonucleotide
agtcatcgtgagtagtatgaacgtg

SEQ ID NO: 741262 - DNA, 25 bp, Artificial sequence
  Synthetic oligonucleotide
actcgttgatagtcaaccaagctcg

SEQ ID NO: 741263 - DNA, 25 bp, Artificial sequence
  Synthetic oligonucleotide
gatacttcgataccgttgtgaatag

SEQ ID NO: 741264 - DNA, 25 bp, Artificial sequence
  Synthetic oligonucleotide
atgagctacgtaactacagtgatag

SEQ ID NO: 741265 - DNA, 25 bp, Artificial sequence
  Synthetic oligonucleotide
gggcacgttgtttaactgttgccgc

SEQ ID NO: 741266 - DNA, 25 bp, Artificial sequence
  Synthetic oligonucleotide
gggcacgttgttaaactgttgccgc

SEQ ID NO: 741267 - DNA, 25 bp, Artificial sequence
  Synthetic oligonucleotide
ccaattcaagattagtccagctcgt

SEQ ID NO: 741268 - DNA, 25 bp, Artificial sequence
  Synthetic oligonucleotide
actcgttgatagacaaccaagctcg

SEQ ID NO: 741269 - DNA, 25 bp, Artificial sequence
  Synthetic oligonucleotide
tacgagatgagcaacgtaactacag

SEQ ID NO: 741270 - DNA, 25 bp, Artificial sequence
  Synthetic oligonucleotide
atgagctacgtatctacagtgatag

SEQ ID NO: 741271 - DNA, 25 bp, Artificial sequence
  Synthetic oligonucleotide
agtcatcgtgagaagtatgaacgtg

SEQ ID NO: 741272 - DNA, 25 bp, Artificial sequence
  Synthetic oligonucleotide
tacgagatgagctacgtaactacag

SEQ ID NO: 741273 - DNA, 25 bp, Artificial sequence
  Synthetic oligonucleotide
ctatctggtaattactgcggtgatc

SEQ ID NO: 741274 - DNA, 25 bp, Artificial sequence
  Synthetic oligonucleotide
cttacttacgagcctactattcgat

SEQ ID NO: 741275 - DNA, 25 bp, Artificial sequence
  Synthetic oligonucleotide
ccctgtggtcgtttaatcgagcgcg

SEQ ID NO: 741276 - DNA, 25 bp, Artificial sequence
  Synthetic oligonucleotide
ccctgtggtcgtataatcgagcgcg

SEQ ID NO: 741277 - DNA, 25 bp, Artificial sequence
  Synthetic oligonucleotide
ccacctctggtcaaatatagcgccc

SEQ ID NO: 741278 - DNA, 25 bp, Artificial sequence
  Synthetic oligonucleotide
ccacctctggtctaatatagcgccc

SEQ ID NO: 741279 - DNA, 25 bp, Artificial sequence
  Synthetic oligonucleotide
caatataacacggagtcgtcaatca

SEQ ID NO: 741280 - DNA, 25 bp, Artificial sequence
  Synthetic oligonucleotide
caatataacacgcagtcgtcaatca

SEQ ID NO: 741281 - DNA, 25 bp, Artificial sequence
  Synthetic oligonucleotide
cctggtagcaaaaacggcgagctgg

SEQ ID NO: 741282 - DNA, 25 bp, Artificial sequence
  Synthetic oligonucleotide
cctggtagcaaatacggcgagctgg

SEQ ID NO: 741283 - DNA, 25 bp, Artificial sequence
  Synthetic oligonucleotide
atctggtaataagtgcggtgatctg

SEQ ID NO: 741284 - DNA, 25 bp, Artificial sequence
  Synthetic oligonucleotide
ctatctggtaataactgcggtgatc

SEQ ID NO: 741285 - DNA, 25 bp, Artificial sequence
  Synthetic oligonucleotide
cttacttacgaggctactattcgat

SEQ ID NO: 741286 - DNA, 25 bp, Artificial sequence
  Synthetic oligonucleotide
tgctacatcagtcgcgatgttcgta

SEQ ID NO: 741287 - DNA, 25 bp, Artificial sequence
  Synthetic oligonucleotide
tgctacatcagtggcgatgttcgta

SEQ ID NO: 741288 - DNA, 25 bp, Artificial sequence
  Synthetic oligonucleotide
tgctcgatacgggaaatatagctcc

SEQ ID NO: 741289 - DNA, 25 bp, Artificial sequence
  Synthetic oligonucleotide
tgctcgatacggcaaatatagctcc

SEQ ID NO: 741290 - DNA, 25 bp, Artificial sequence
  Synthetic oligonucleotide
gatacgggcgatttaatgctcgata

SEQ ID NO: 741291 - DNA, 25 bp, Artificial sequence
  Synthetic oligonucleotide
gatacgggcgatataatgctcgata

SEQ ID NO: 741292 - DNA, 25 bp, Artificial sequence
  Synthetic oligonucleotide
ggtgtctaatacatcgtgatacggg

SEQ ID NO: 741293 - DNA, 25 bp, Artificial sequence
  Synthetic oligonucleotide
ggtgtctaatacttcgtgatacggg

SEQ ID NO: 741294 - DNA, 25 bp, Artificial sequence
  Synthetic oligonucleotide
atctggtaataactgcggtgatctg

SEQ ID NO: 741295 - DNA, 25 bp, Artificial sequence
  Synthetic oligonucleotide
gatacgggcgatataatgctcgata

SEQ ID NO: 741296 - DNA, 25 bp, Artificial sequence
  Synthetic oligonucleotide
ccctgtggtcgtttaatcgagcgcg

SEQ ID NO: 741297 - DNA, 25 bp, Artificial sequence
  Synthetic oligonucleotide
ggtgtctaatacttcgtgatacggg

SEQ ID NO: 741298 - DNA, 25 bp, Artificial sequence
  Synthetic oligonucleotide
ccctgtggtcgtataatcgagcgcg

SEQ ID NO: 741299 - DNA, 25 bp, Artificial sequence
  Synthetic oligonucleotide
ccacctctggtcaaatatagcgccc

SEQ ID NO: 741300 - DNA, 25 bp, Artificial sequence
  Synthetic oligonucleotide
ccacctctggtctaatatagcgccc

SEQ ID NO: 741301 - DNA, 25 bp, Artificial sequence
  Synthetic oligonucleotide
caatataacacgcagtcgtcaatca

SEQ ID NO: 741302 - DNA, 25 bp, Artificial sequence
  Synthetic oligonucleotide
caatataacacggagtcgtcaatca

SEQ ID NO: 741303 - DNA, 25 bp, Artificial sequence
  Synthetic oligonucleotide
cctggtagcaaatacggcgagctgg

SEQ ID NO: 741304 - DNA, 25 bp, Artificial sequence
  Synthetic oligonucleotide
cctggtagcaaaaacggcgagctgg

SEQ ID NO: 741305 - DNA, 25 bp, Artificial sequence
  Synthetic oligonucleotide
atctggtaataagtgcggtgatctg

SEQ ID NO: 741306 - DNA, 25 bp, Artificial sequence
  Synthetic oligonucleotide
atctggtaataactgcggtgatctg

SEQ ID NO: 741307 - DNA, 25 bp, Artificial sequence
  Synthetic oligonucleotide
gatacgggcgatttaatgctcgata

SEQ ID NO: 741308 - DNA, 25 bp, Artificial sequence
  Synthetic oligonucleotide
ctatctggtaataactgcggtgatc

SEQ ID NO: 741309 - DNA, 25 bp, Artificial sequence
  Synthetic oligonucleotide
cttacttacgagcctactattcgat

SEQ ID NO: 741310 - DNA, 25 bp, Artificial sequence
  Synthetic oligonucleotide
cttacttacgaggctactattcgat

SEQ ID NO: 741311 - DNA, 25 bp, Artificial sequence
  Synthetic oligonucleotide
tgctacatcagtcgcgatgttcgta

SEQ ID NO: 741312 - DNA, 25 bp, Artificial sequence
  Synthetic oligonucleotide
tgctacatcagtggcgatgttcgta

SEQ ID NO: 741313 - DNA, 25 bp, Artificial sequence
  Synthetic oligonucleotide
tgctcgatacgggaaatatagctcc

SEQ ID NO: 741314 - DNA, 25 bp, Artificial sequence
  Synthetic oligonucleotide
tgctcgatacggcaaatatagctcc

SEQ ID NO: 741315 - DNA, 25 bp, Artificial sequence
  Synthetic oligonucleotide
ggtgtctaatacatcgtgatacggg

SEQ ID NO: 741316 - DNA, 25 bp, Artificial sequence
  Synthetic oligonucleotide
ctatctggtaattactgcggtgatc

SEQ ID NO: 741317 - DNA, 25 bp, Artificial sequence
  Synthetic oligonucleotide
atcgagtgagtacatgattcgtcag

SEQ ID NO: 741318 - DNA, 25 bp, Artificial sequence
  Synthetic oligonucleotide
tcatcggtccgaacaattagtctag

SEQ ID NO: 741319 - DNA, 25 bp, Artificial sequence
  Synthetic oligonucleotide
tcatcggtccgatcaattagtctag

SEQ ID NO: 741320 - DNA, 25 bp, Artificial sequence
  Synthetic oligonucleotide
ctcatacagcgttacggtcgctgcg

SEQ ID NO: 741321 - DNA, 25 bp, Artificial sequence
  Synthetic oligonucleotide
ctcatacagcgtaacggtcgctgcg

SEQ ID NO: 741322 - DNA, 25 bp, Artificial sequence
  Synthetic oligonucleotide
atcatataggatgcggcgatctcat

SEQ ID NO: 741323 - DNA, 25 bp, Artificial sequence
  Synthetic oligonucleotide
atcatataggatccggcgatctcat

SEQ ID NO: 741324 - DNA, 25 bp, Artificial sequence
  Synthetic oligonucleotide
atcgagtgagtagatgattcgtcag

SEQ ID NO: 741325 - DNA, 25 bp, Artificial sequence
  Synthetic oligonucleotide
tgtcgtccatgtttagacagtgcgc

SEQ ID NO: 741326 - DNA, 25 bp, Artificial sequence
  Synthetic oligonucleotide
tgtgattctcgagcgatttatacat

SEQ ID NO: 741327 - DNA, 25 bp, Artificial sequence
  Synthetic oligonucleotide
tgtcgtccatgtatagacagtgcgc

SEQ ID NO: 741328 - DNA, 25 bp, Artificial sequence
  Synthetic oligonucleotide
tgtggatcaatttcagttaggccgc

SEQ ID NO: 741329 - DNA, 25 bp, Artificial sequence
  Synthetic oligonucleotide
tgtggatcaattacagttaggccgc

SEQ ID NO: 741330 - DNA, 25 bp, Artificial sequence
  Synthetic oligonucleotide
ccgctgacacattagtaacgtcggc

SEQ ID NO: 741331 - DNA, 25 bp, Artificial sequence
  Synthetic oligonucleotide
cacgactgaatccagcttaagagcc

SEQ ID NO: 741332 - DNA, 25 bp, Artificial sequence
  Synthetic oligonucleotide
tgtgattctcgaccgatttatacat

SEQ ID NO: 741333 - DNA, 25 bp, Artificial sequence
  Synthetic oligonucleotide
ctgacagactggttggttatccaat

SEQ ID NO: 741334 - DNA, 25 bp, Artificial sequence
  Synthetic oligonucleotide
ctgacagactggatggttatccaat

SEQ ID NO: 741335 - DNA, 25 bp, Artificial sequence
  Synthetic oligonucleotide
cacgactgaatcgagcttaagagcc

SEQ ID NO: 741336 - DNA, 25 bp, Artificial sequence
  Synthetic oligonucleotide
tgtatatcgaggtgagtctatctgg

SEQ ID NO: 741337 - DNA, 25 bp, Artificial sequence
  Synthetic oligonucleotide
tgtatatcgaggagagtctatctgg

SEQ ID NO: 741338 - DNA, 25 bp, Artificial sequence
  Synthetic oligonucleotide
ccgctgacacataagtaacgtcggc

SEQ ID NO: 741339 - DNA, 25 bp, Artificial sequence
  Synthetic oligonucleotide
tgtcgtccatgtttagacagtgcgc

SEQ ID NO: 741340 - DNA, 25 bp, Artificial sequence
  Synthetic oligonucleotide
cacgactgaatccagcttaagagcc

SEQ ID NO: 741341 - DNA, 25 bp, Artificial sequence
  Synthetic oligonucleotide
tgtatatcgaggagagtctatctgg

SEQ ID NO: 741342 - DNA, 25 bp, Artificial sequence
  Synthetic oligonucleotide
tgtcgtccatgtatagacagtgcgc

SEQ ID NO: 741343 - DNA, 25 bp, Artificial sequence
  Synthetic oligonucleotide
atcatataggatgcggcgatctcat

SEQ ID NO: 741344 - DNA, 25 bp, Artificial sequence
  Synthetic oligonucleotide
atcatataggatccggcgatctcat

SEQ ID NO: 741345 - DNA, 25 bp, Artificial sequence
  Synthetic oligonucleotide
ctcatacagcgttacggtcgctgcg

SEQ ID NO: 741346 - DNA, 25 bp, Artificial sequence
  Synthetic oligonucleotide
ctcatacagcgtaacggtcgctgcg

SEQ ID NO: 741347 - DNA, 25 bp, Artificial sequence
  Synthetic oligonucleotide
tcatcggtccgatcaattagtctag

SEQ ID NO: 741348 - DNA, 25 bp, Artificial sequence
  Synthetic oligonucleotide
tcatcggtccgaacaattagtctag

SEQ ID NO: 741349 - DNA, 25 bp, Artificial sequence
  Synthetic oligonucleotide
atcgagtgagtacatgattcgtcag

SEQ ID NO: 741350 - DNA, 25 bp, Artificial sequence
  Synthetic oligonucleotide
cacgactgaatcgagcttaagagcc

SEQ ID NO: 741351 - DNA, 25 bp, Artificial sequence
  Synthetic oligonucleotide
tgtggatcaattacagttaggccgc

SEQ ID NO: 741352 - DNA, 25 bp, Artificial sequence
  Synthetic oligonucleotide
tgtggatcaatttcagttaggccgc

SEQ ID NO: 741353 - DNA, 25 bp, Artificial sequence
  Synthetic oligonucleotide
ccgctgacacattagtaacgtcggc

SEQ ID NO: 741354 - DNA, 25 bp, Artificial sequence
  Synthetic oligonucleotide
ccgctgacacataagtaacgtcggc

SEQ ID NO: 741355 - DNA, 25 bp, Artificial sequence
  Synthetic oligonucleotide
tgtgattctcgaccgatttatacat

SEQ ID NO: 741356 - DNA, 25 bp, Artificial sequence
  Synthetic oligonucleotide
tgtgattctcgagcgatttatacat

SEQ ID NO: 741357 - DNA, 25 bp, Artificial sequence
  Synthetic oligonucleotide
ctgacagactggttggttatccaat

SEQ ID NO: 741358 - DNA, 25 bp, Artificial sequence
  Synthetic oligonucleotide
ctgacagactggatggttatccaat

SEQ ID NO: 741359 - DNA, 25 bp, Artificial sequence
  Synthetic oligonucleotide
tgtatatcgaggtgagtctatctgg

SEQ ID NO: 741360 - DNA, 25 bp, Artificial sequence
  Synthetic oligonucleotide
atcgagtgagtagatgattcgtcag

SEQ ID NO: 741361 - DNA, 25 bp, Artificial sequence
  Synthetic oligonucleotide
tggctgagtatgtaacgctatggcg

SEQ ID NO: 741362 - DNA, 25 bp, Artificial sequence
  Synthetic oligonucleotide
aatgtatgtgctcttatcgaagcct

SEQ ID NO: 741363 - DNA, 25 bp, Artificial sequence
  Synthetic oligonucleotide
aatgtatgtgctgttatcgaagcct

SEQ ID NO: 741364 - DNA, 25 bp, Artificial sequence
  Synthetic oligonucleotide
atgtgacgcagcacttagcgcaatg

SEQ ID NO: 741365 - DNA, 25 bp, Artificial sequence
  Synthetic oligonucleotide
atgtgacgcagctcttagcgcaatg

SEQ ID NO: 741366 - DNA, 25 bp, Artificial sequence
  Synthetic oligonucleotide
ctgatcggcttatgacgtatgtgac

SEQ ID NO: 741367 - DNA, 25 bp, Artificial sequence
  Synthetic oligonucleotide
tggctgagtatgaaacgctatggcg

SEQ ID NO: 741368 - DNA, 25 bp, Artificial sequence
  Synthetic oligonucleotide
tcagccaatagaagcctagtacgct

SEQ ID NO: 741369 - DNA, 25 bp, Artificial sequence
  Synthetic oligonucleotide
gaactgtcgatgatggtcacgactc

SEQ ID NO: 741370 - DNA, 25 bp, Artificial sequence
  Synthetic oligonucleotide
ctgatcggcttaagacgtatgtgac

SEQ ID NO: 741371 - DNA, 25 bp, Artificial sequence
  Synthetic oligonucleotide
gtatgtaacgctatggcgtgctagt

SEQ ID NO: 741372 - DNA, 25 bp, Artificial sequence
  Synthetic oligonucleotide
gtatgtaacgctttggcgtgctagt

SEQ ID NO: 741373 - DNA, 25 bp, Artificial sequence
  Synthetic oligonucleotide
ctgatgacctcgtatcatgttatag

SEQ ID NO: 741374 - DNA, 25 bp, Artificial sequence
  Synthetic oligonucleotide
ctgatgacctcgaatcatgttatag

SEQ ID NO: 741375 - DNA, 25 bp, Artificial sequence
  Synthetic oligonucleotide
tatcatgttatacggctgcgaactg

SEQ ID NO: 741376 - DNA, 25 bp, Artificial sequence
  Synthetic oligonucleotide
gaactgtcgatgttggtcacgactc

SEQ ID NO: 741377 - DNA, 25 bp, Artificial sequence
  Synthetic oligonucleotide
agaaggtgtgcagcctatatgatac

SEQ ID NO: 741378 - DNA, 25 bp, Artificial sequence
  Synthetic oligonucleotide
agaaggtgtgcaccctatatgatac

SEQ ID NO: 741379 - DNA, 25 bp, Artificial sequence
  Synthetic oligonucleotide
cagtacatggtacttcagccaatag

SEQ ID NO: 741380 - DNA, 25 bp, Artificial sequence
  Synthetic oligonucleotide
cagtacatggtagttcagccaatag

SEQ ID NO: 741381 - DNA, 25 bp, Artificial sequence
  Synthetic oligonucleotide
tatcatgttatagggctgcgaactg

SEQ ID NO: 741382 - DNA, 25 bp, Artificial sequence
  Synthetic oligonucleotide
tcagccaatagatgcctagtacgct

SEQ ID NO: 741383 - DNA, 25 bp, Artificial sequence
  Synthetic oligonucleotide
tcagccaatagatgcctagtacgct

SEQ ID NO: 741384 - DNA, 25 bp, Artificial sequence
  Synthetic oligonucleotide
agaaggtgtgcaccctatatgatac

SEQ ID NO: 741385 - DNA, 25 bp, Artificial sequence
  Synthetic oligonucleotide
cagtacatggtagttcagccaatag

SEQ ID NO: 741386 - DNA, 25 bp, Artificial sequence
  Synthetic oligonucleotide
tcagccaatagaagcctagtacgct

SEQ ID NO: 741387 - DNA, 25 bp, Artificial sequence
  Synthetic oligonucleotide
ctgatcggcttaagacgtatgtgac

SEQ ID NO: 741388 - DNA, 25 bp, Artificial sequence
  Synthetic oligonucleotide
ctgatcggcttatgacgtatgtgac

SEQ ID NO: 741389 - DNA, 25 bp, Artificial sequence
  Synthetic oligonucleotide
atgtgacgcagcacttagcgcaatg

SEQ ID NO: 741390 - DNA, 25 bp, Artificial sequence
  Synthetic oligonucleotide
atgtgacgcagctcttagcgcaatg

SEQ ID NO: 741391 - DNA, 25 bp, Artificial sequence
  Synthetic oligonucleotide
aatgtatgtgctgttatcgaagcct

SEQ ID NO: 741392 - DNA, 25 bp, Artificial sequence
  Synthetic oligonucleotide
aatgtatgtgctcttatcgaagcct

SEQ ID NO: 741393 - DNA, 25 bp, Artificial sequence
  Synthetic oligonucleotide
tggctgagtatgtaacgctatggcg

SEQ ID NO: 741394 - DNA, 25 bp, Artificial sequence
  Synthetic oligonucleotide
cagtacatggtacttcagccaatag

SEQ ID NO: 741395 - DNA, 25 bp, Artificial sequence
  Synthetic oligonucleotide
tggctgagtatgaaacgctatggcg

SEQ ID NO: 741396 - DNA, 25 bp, Artificial sequence
  Synthetic oligonucleotide
agaaggtgtgcagcctatatgatac

SEQ ID NO: 741397 - DNA, 25 bp, Artificial sequence
  Synthetic oligonucleotide
gaactgtcgatgttggtcacgactc

SEQ ID NO: 741398 - DNA, 25 bp, Artificial sequence
  Synthetic oligonucleotide
gaactgtcgatgatggtcacgactc

SEQ ID NO: 741399 - DNA, 25 bp, Artificial sequence
  Synthetic oligonucleotide
tatcatgttatacggctgcgaactg

SEQ ID NO: 741400 - DNA, 25 bp, Artificial sequence
  Synthetic oligonucleotide
tatcatgttatagggctgcgaactg

SEQ ID NO: 741401 - DNA, 25 bp, Artificial sequence
  Synthetic oligonucleotide
ctgatgacctcgaatcatgttatag

SEQ ID NO: 741402 - DNA, 25 bp, Artificial sequence
  Synthetic oligonucleotide
ctgatgacctcgtatcatgttatag

SEQ ID NO: 741403 - DNA, 25 bp, Artificial sequence
  Synthetic oligonucleotide
gtatgtaacgctttggcgtgctagt

SEQ ID NO: 741404 - DNA, 25 bp, Artificial sequence
  Synthetic oligonucleotide
gtatgtaacgctatggcgtgctagt

SEQ ID NO: 741405 - DNA, 25 bp, Artificial sequence
  Synthetic oligonucleotide
tgcgcctattatatgcctgacgcgg

SEQ ID NO: 741406 - DNA, 25 bp, Artificial sequence
  Synthetic oligonucleotide
ctgtctagcactctagctggtgcat

SEQ ID NO: 741407 - DNA, 25 bp, Artificial sequence
  Synthetic oligonucleotide
tcggctataacagcgagtgctacgc

SEQ ID NO: 741408 - DNA, 25 bp, Artificial sequence
  Synthetic oligonucleotide
tcggctataacaccgagtgctacgc

SEQ ID NO: 741409 - DNA, 25 bp, Artificial sequence
  Synthetic oligonucleotide
cgagtgctacgcctaaactggctgt

SEQ ID NO: 741410 - DNA, 25 bp, Artificial sequence
  Synthetic oligonucleotide
cgagtgctacgcgtaaactggctgt

SEQ ID NO: 741411 - DNA, 25 bp, Artificial sequence
  Synthetic oligonucleotide
cgcctaaactggctgtctagcactg

SEQ ID NO: 741412 - DNA, 25 bp, Artificial sequence
  Synthetic oligonucleotide
cgcctaaactgggtgtctagcactg

SEQ ID NO: 741413 - DNA, 25 bp, Artificial sequence
  Synthetic oligonucleotide
ctgtctagcactgtagctggtgcat

SEQ ID NO: 741414 - DNA, 25 bp, Artificial sequence
  Synthetic oligonucleotide
cagtgatacacggtgatgcacgtag

SEQ ID NO: 741415 - DNA, 25 bp, Artificial sequence
  Synthetic oligonucleotide
gcgtataggctgatacattagctcg

SEQ ID NO: 741416 - DNA, 25 bp, Artificial sequence
  Synthetic oligonucleotide
gcgtataggctgttacattagctcg

SEQ ID NO: 741417 - DNA, 25 bp, Artificial sequence
  Synthetic oligonucleotide
tgatacattagctcggatgctatca

SEQ ID NO: 741418 - DNA, 25 bp, Artificial sequence
  Synthetic oligonucleotide
tgatacattagcacggatgctatca

SEQ ID NO: 741419 - DNA, 25 bp, Artificial sequence
  Synthetic oligonucleotide
atatgacgagactgtgcgctcatag

SEQ ID NO: 741420 - DNA, 25 bp, Artificial sequence
  Synthetic oligonucleotide
gctatcagcttgggcctattatatg

SEQ ID NO: 741421 - DNA, 25 bp, Artificial sequence
  Synthetic oligonucleotide
tgcgcctattatttgcctgacgcgg

SEQ ID NO: 741422 - DNA, 25 bp, Artificial sequence
  Synthetic oligonucleotide
gccgtgatcgttatatgacgagact

SEQ ID NO: 741423 - DNA, 25 bp, Artificial sequence
  Synthetic oligonucleotide
gccgtgatcgttttatgacgagact

SEQ ID NO: 741424 - DNA, 25 bp, Artificial sequence
  Synthetic oligonucleotide
atatgacgagacagtgcgctcatag

SEQ ID NO: 741425 - DNA, 25 bp, Artificial sequence
  Synthetic oligonucleotide
cagtgatacacgctgatgcacgtag

SEQ ID NO: 741426 - DNA, 25 bp, Artificial sequence
  Synthetic oligonucleotide
gctatcagcttgcgcctattatatg

SEQ ID NO: 741427 - DNA, 25 bp, Artificial sequence
  Synthetic oligonucleotide
cgagtgctacgcgtaaactggctgt

SEQ ID NO: 741428 - DNA, 25 bp, Artificial sequence
  Synthetic oligonucleotide
atatgacgagactgtgcgctcatag

SEQ ID NO: 741429 - DNA, 25 bp, Artificial sequence
  Synthetic oligonucleotide
atatgacgagacagtgcgctcatag

SEQ ID NO: 741430 - DNA, 25 bp, Artificial sequence
  Synthetic oligonucleotide
cagtgatacacgctgatgcacgtag

SEQ ID NO: 741431 - DNA, 25 bp, Artificial sequence
  Synthetic oligonucleotide
cagtgatacacggtgatgcacgtag

SEQ ID NO: 741432 - DNA, 25 bp, Artificial sequence
  Synthetic oligonucleotide
tcggctataacagcgagtgctacgc

SEQ ID NO: 741433 - DNA, 25 bp, Artificial sequence
  Synthetic oligonucleotide
cgagtgctacgcctaaactggctgt

SEQ ID NO: 741434 - DNA, 25 bp, Artificial sequence
  Synthetic oligonucleotide
cgcctaaactggctgtctagcactg

SEQ ID NO: 741435 - DNA, 25 bp, Artificial sequence
  Synthetic oligonucleotide
cgcctaaactgggtgtctagcactg

SEQ ID NO: 741436 - DNA, 25 bp, Artificial sequence
  Synthetic oligonucleotide
ctgtctagcactgtagctggtgcat

SEQ ID NO: 741437 - DNA, 25 bp, Artificial sequence
  Synthetic oligonucleotide
ctgtctagcactctagctggtgcat

SEQ ID NO: 741438 - DNA, 25 bp, Artificial sequence
  Synthetic oligonucleotide
gccgtgatcgttatatgacgagact

SEQ ID NO: 741439 - DNA, 25 bp, Artificial sequence
  Synthetic oligonucleotide
tcggctataacaccgagtgctacgc

SEQ ID NO: 741440 - DNA, 25 bp, Artificial sequence
  Synthetic oligonucleotide
gccgtgatcgttttatgacgagact

SEQ ID NO: 741441 - DNA, 25 bp, Artificial sequence
  Synthetic oligonucleotide
gcgtataggctgatacattagctcg

SEQ ID NO: 741442 - DNA, 25 bp, Artificial sequence
  Synthetic oligonucleotide
tgcgcctattatttgcctgacgcgg

SEQ ID NO: 741443 - DNA, 25 bp, Artificial sequence
  Synthetic oligonucleotide
tgcgcctattatatgcctgacgcgg

SEQ ID NO: 741444 - DNA, 25 bp, Artificial sequence
  Synthetic oligonucleotide
gctatcagcttgggcctattatatg

SEQ ID NO: 741445 - DNA, 25 bp, Artificial sequence
  Synthetic oligonucleotide
gctatcagcttgcgcctattatatg

SEQ ID NO: 741446 - DNA, 25 bp, Artificial sequence
  Synthetic oligonucleotide
tgatacattagcacggatgctatca

SEQ ID NO: 741447 - DNA, 25 bp, Artificial sequence
  Synthetic oligonucleotide
tgatacattagctcggatgctatca

SEQ ID NO: 741448 - DNA, 25 bp, Artificial sequence
  Synthetic oligonucleotide
gcgtataggctgttacattagctcg

SEQ ID NO: 741449 - DNA, 25 bp, Artificial sequence
  Synthetic oligonucleotide
tatgagccgcaaagcacgactgata

SEQ ID NO: 741450 - DNA, 25 bp, Artificial sequence
  Synthetic oligonucleotide
tggtggagctatttaagccgctgtt

SEQ ID NO: 741451 - DNA, 25 bp, Artificial sequence
  Synthetic oligonucleotide
ctatgaccgcgtgatgctaactgat

SEQ ID NO: 741452 - DNA, 25 bp, Artificial sequence
  Synthetic oligonucleotide
ctatgaccgcgtcatgctaactgat

SEQ ID NO: 741453 - DNA, 25 bp, Artificial sequence
  Synthetic oligonucleotide
acactgataactatgcgcagacgct

SEQ ID NO: 741454 - DNA, 25 bp, Artificial sequence
  Synthetic oligonucleotide
acactgataactttgcgcagacgct

SEQ ID NO: 741455 - DNA, 25 bp, Artificial sequence
  Synthetic oligonucleotide
tgcgcagacgcttgaaacgatgtga

SEQ ID NO: 741456 - DNA, 25 bp, Artificial sequence
  Synthetic oligonucleotide
tgcgcagacgctagaaacgatgtga

SEQ ID NO: 741457 - DNA, 25 bp, Artificial sequence
  Synthetic oligonucleotide
cttctagagtatgagccgcaatgca

SEQ ID NO: 741458 - DNA, 25 bp, Artificial sequence
  Synthetic oligonucleotide
cttctagagtatcagccgcaatgca

SEQ ID NO: 741459 - DNA, 25 bp, Artificial sequence
  Synthetic oligonucleotide
tggtggagctatataagccgctgtt

SEQ ID NO: 741460 - DNA, 25 bp, Artificial sequence
  Synthetic oligonucleotide
tatgagccgcaatgcacgactgata

SEQ ID NO: 741461 - DNA, 25 bp, Artificial sequence
  Synthetic oligonucleotide
tgcaatgcttgcagtatgtatcctg

SEQ ID NO: 741462 - DNA, 25 bp, Artificial sequence
  Synthetic oligonucleotide
tgcaatgcttgctgtatgtatcctg

SEQ ID NO: 741463 - DNA, 25 bp, Artificial sequence
  Synthetic oligonucleotide
tgcgatgtctgataatacgctcgca

SEQ ID NO: 741464 - DNA, 25 bp, Artificial sequence
  Synthetic oligonucleotide
tgcgatgtctgaaaatacgctcgca

SEQ ID NO: 741465 - DNA, 25 bp, Artificial sequence
  Synthetic oligonucleotide
acgctcgcatgatatgtattgcgct

SEQ ID NO: 741466 - DNA, 25 bp, Artificial sequence
  Synthetic oligonucleotide
acgctcgcatgaaatgtattgcgct

SEQ ID NO: 741467 - DNA, 25 bp, Artificial sequence
  Synthetic oligonucleotide
ctcgcatgatatgtattgcgctcag

SEQ ID NO: 741468 - DNA, 25 bp, Artificial sequence
  Synthetic oligonucleotide
ctcgcatgatatctattgcgctcag

SEQ ID NO: 741469 - DNA, 25 bp, Artificial sequence
  Synthetic oligonucleotide
catgatatgtattgcgctcagatgc

SEQ ID NO: 741470 - DNA, 25 bp, Artificial sequence
  Synthetic oligonucleotide
catgatatgtatagcgctcagatgc

SEQ ID NO: 741471 - DNA, 25 bp, Artificial sequence
  Synthetic oligonucleotide
tgcaatgcttgcagtatgtatcctg

SEQ ID NO: 741472 - DNA, 25 bp, Artificial sequence
  Synthetic oligonucleotide
tggtggagctatttaagccgctgtt

SEQ ID NO: 741473 - DNA, 25 bp, Artificial sequence
  Synthetic oligonucleotide
catgatatgtattgcgctcagatgc

SEQ ID NO: 741474 - DNA, 25 bp, Artificial sequence
  Synthetic oligonucleotide
ctatgaccgcgtcatgctaactgat

SEQ ID NO: 741475 - DNA, 25 bp, Artificial sequence
  Synthetic oligonucleotide
ctatgaccgcgtgatgctaactgat

SEQ ID NO: 741476 - DNA, 25 bp, Artificial sequence
  Synthetic oligonucleotide
acactgataactatgcgcagacgct

SEQ ID NO: 741477 - DNA, 25 bp, Artificial sequence
  Synthetic oligonucleotide
acactgataactttgcgcagacgct

SEQ ID NO: 741478 - DNA, 25 bp, Artificial sequence
  Synthetic oligonucleotide
tgcgcagacgctagaaacgatgtga

SEQ ID NO: 741479 - DNA, 25 bp, Artificial sequence
  Synthetic oligonucleotide
tgcgcagacgcttgaaacgatgtga

SEQ ID NO: 741480 - DNA, 25 bp, Artificial sequence
  Synthetic oligonucleotide
cttctagagtatcagccgcaatgca

SEQ ID NO: 741481 - DNA, 25 bp, Artificial sequence
  Synthetic oligonucleotide
cttctagagtatgagccgcaatgca

SEQ ID NO: 741482 - DNA, 25 bp, Artificial sequence
  Synthetic oligonucleotide
tatgagccgcaatgcacgactgata

SEQ ID NO: 741483 - DNA, 25 bp, Artificial sequence
  Synthetic oligonucleotide
catgatatgtatagcgctcagatgc

SEQ ID NO: 741484 - DNA, 25 bp, Artificial sequence
  Synthetic oligonucleotide
tgcaatgcttgctgtatgtatcctg

SEQ ID NO: 741485 - DNA, 25 bp, Artificial sequence
  Synthetic oligonucleotide
tgcgatgtctgataatacgctcgca

SEQ ID NO: 741486 - DNA, 25 bp, Artificial sequence
  Synthetic oligonucleotide
tgcgatgtctgaaaatacgctcgca

SEQ ID NO: 741487 - DNA, 25 bp, Artificial sequence
  Synthetic oligonucleotide
tggtggagctatataagccgctgtt

SEQ ID NO: 741488 - DNA, 25 bp, Artificial sequence
  Synthetic oligonucleotide
acgctcgcatgaaatgtattgcgct

SEQ ID NO: 741489 - DNA, 25 bp, Artificial sequence
  Synthetic oligonucleotide
acgctcgcatgatatgtattgcgct

SEQ ID NO: 741490 - DNA, 25 bp, Artificial sequence
  Synthetic oligonucleotide
ctcgcatgatatgtattgcgctcag

SEQ ID NO: 741491 - DNA, 25 bp, Artificial sequence
  Synthetic oligonucleotide
ctcgcatgatatctattgcgctcag

SEQ ID NO: 741492 - DNA, 25 bp, Artificial sequence
  Synthetic oligonucleotide
tatgagccgcaaagcacgactgata

SEQ ID NO: 741493 - DNA, 25 bp, Artificial sequence
  Synthetic oligonucleotide
cgagtcgtatgtttcatgtcgggct

SEQ ID NO: 741494 - DNA, 25 bp, Artificial sequence
  Synthetic oligonucleotide
attagcgagtcgaatgtatcatgtc

SEQ ID NO: 741495 - DNA, 25 bp, Artificial sequence
  Synthetic oligonucleotide
attagcgagtcgtatgtatcatgtc

SEQ ID NO: 741496 - DNA, 25 bp, Artificial sequence
  Synthetic oligonucleotide
taacatggagcaacgttatctaaag

SEQ ID NO: 741497 - DNA, 25 bp, Artificial sequence
  Synthetic oligonucleotide
taacatggagcatcgttatctaaag

SEQ ID NO: 741498 - DNA, 25 bp, Artificial sequence
  Synthetic oligonucleotide
attcactaacatcgagcatcgttat

SEQ ID NO: 741499 - DNA, 25 bp, Artificial sequence
  Synthetic oligonucleotide
cgagtcgtatgtatcatgtcgggct

SEQ ID NO: 741500 - DNA, 25 bp, Artificial sequence
  Synthetic oligonucleotide
cattagagtgatgttctcggatcga

SEQ ID NO: 741501 - DNA, 25 bp, Artificial sequence
  Synthetic oligonucleotide
ttgggcgttgttcacccgaattcgg

SEQ ID NO: 741502 - DNA, 25 bp, Artificial sequence
  Synthetic oligonucleotide
attcactaacatggagcatcgttat

SEQ ID NO: 741503 - DNA, 25 bp, Artificial sequence
  Synthetic oligonucleotide
cgtagccacaaatgtcgttaggtag

SEQ ID NO: 741504 - DNA, 25 bp, Artificial sequence
  Synthetic oligonucleotide
cgtagccacaaaagtcgttaggtag

SEQ ID NO: 741505 - DNA, 25 bp, Artificial sequence
  Synthetic oligonucleotide
gatgtcaacgcgtgttagaccgtat

SEQ ID NO: 741506 - DNA, 25 bp, Artificial sequence
  Synthetic oligonucleotide
gatgtcaacgcgagttagaccgtat

SEQ ID NO: 741507 - DNA, 25 bp, Artificial sequence
  Synthetic oligonucleotide
acgtcgtctgctttaggcaaacgtc

SEQ ID NO: 741508 - DNA, 25 bp, Artificial sequence
  Synthetic oligonucleotide
tggcgtacttctgaaacgtgatggg

SEQ ID NO: 741509 - DNA, 25 bp, Artificial sequence
  Synthetic oligonucleotide
ttgggcgttgttgacccgaattcgg

SEQ ID NO: 741510 - DNA, 25 bp, Artificial sequence
  Synthetic oligonucleotide
acgtcgtctgctataggcaaacgtc

SEQ ID NO: 741511 - DNA, 25 bp, Artificial sequence
  Synthetic oligonucleotide
agaggatggcactcgtcattagagt

SEQ ID NO: 741512 - DNA, 25 bp, Artificial sequence
  Synthetic oligonucleotide
agaggatggcacacgtcattagagt

SEQ ID NO: 741513 - DNA, 25 bp, Artificial sequence
  Synthetic oligonucleotide
tggcgtacttctcaaacgtgatggg

SEQ ID NO: 741514 - DNA, 25 bp, Artificial sequence
  Synthetic oligonucleotide
cattagagtgatcttctcggatcga

SEQ ID NO: 741515 - DNA, 25 bp, Artificial sequence
  Synthetic oligonucleotide
attagcgagtcgaatgtatcatgtc

SEQ ID NO: 741516 - DNA, 25 bp, Artificial sequence
  Synthetic oligonucleotide
agaggatggcactcgtcattagagt

SEQ ID NO: 741517 - DNA, 25 bp, Artificial sequence
  Synthetic oligonucleotide
acgtcgtctgctttaggcaaacgtc

SEQ ID NO: 741518 - DNA, 25 bp, Artificial sequence
  Synthetic oligonucleotide
cattagagtgatgttctcggatcga

SEQ ID NO: 741519 - DNA, 25 bp, Artificial sequence
  Synthetic oligonucleotide
cattagagtgatcttctcggatcga

SEQ ID NO: 741520 - DNA, 25 bp, Artificial sequence
  Synthetic oligonucleotide
attcactaacatcgagcatcgttat

SEQ ID NO: 741521 - DNA, 25 bp, Artificial sequence
  Synthetic oligonucleotide
attcactaacatggagcatcgttat

SEQ ID NO: 741522 - DNA, 25 bp, Artificial sequence
  Synthetic oligonucleotide
taacatggagcatcgttatctaaag

SEQ ID NO: 741523 - DNA, 25 bp, Artificial sequence
  Synthetic oligonucleotide
agaggatggcacacgtcattagagt

SEQ ID NO: 741524 - DNA, 25 bp, Artificial sequence
  Synthetic oligonucleotide
attagcgagtcgtatgtatcatgtc

SEQ ID NO: 741525 - DNA, 25 bp, Artificial sequence
  Synthetic oligonucleotide
cgagtcgtatgtatcatgtcgggct

SEQ ID NO: 741526 - DNA, 25 bp, Artificial sequence
  Synthetic oligonucleotide
ttgggcgttgttcacccgaattcgg

SEQ ID NO: 741527 - DNA, 25 bp, Artificial sequence
  Synthetic oligonucleotide
cgtagccacaaatgtcgttaggtag

SEQ ID NO: 741528 - DNA, 25 bp, Artificial sequence
  Synthetic oligonucleotide
cgtagccacaaaagtcgttaggtag

SEQ ID NO: 741529 - DNA, 25 bp, Artificial sequence
  Synthetic oligonucleotide
gatgtcaacgcgtgttagaccgtat

SEQ ID NO: 741530 - DNA, 25 bp, Artificial sequence
  Synthetic oligonucleotide
gatgtcaacgcgagttagaccgtat

SEQ ID NO: 741531 - DNA, 25 bp, Artificial sequence
  Synthetic oligonucleotide
tggcgtacttctgaaacgtgatggg

SEQ ID NO: 741532 - DNA, 25 bp, Artificial sequence
  Synthetic oligonucleotide
tggcgtacttctcaaacgtgatggg

SEQ ID NO: 741533 - DNA, 25 bp, Artificial sequence
  Synthetic oligonucleotide
ttgggcgttgttgacccgaattcgg

SEQ ID NO: 741534 - DNA, 25 bp, Artificial sequence
  Synthetic oligonucleotide
cgagtcgtatgtttcatgtcgggct

SEQ ID NO: 741535 - DNA, 25 bp, Artificial sequence
  Synthetic oligonucleotide
taacatggagcaacgttatctaaag

SEQ ID NO: 741536 - DNA, 25 bp, Artificial sequence
  Synthetic oligonucleotide
acgtcgtctgctataggcaaacgtc

SEQ ID NO: 741537 - DNA, 25 bp, Artificial sequence
  Synthetic oligonucleotide
ctgcgatactgaagatgcaccgcta

SEQ ID NO: 741538 - DNA, 25 bp, Artificial sequence
  Synthetic oligonucleotide
tacagcgatataccctggattgtga

SEQ ID NO: 741539 - DNA, 25 bp, Artificial sequence
  Synthetic oligonucleotide
accatcctgcgaaactgaagatgca

SEQ ID NO: 741540 - DNA, 25 bp, Artificial sequence
  Synthetic oligonucleotide
gcataggtgcaacgctcctagcatg

SEQ ID NO: 741541 - DNA, 25 bp, Artificial sequence
  Synthetic oligonucleotide
accatcctgcgatactgaagatgca

SEQ ID NO: 741542 - DNA, 25 bp, Artificial sequence
  Synthetic oligonucleotide
aacctcagctcatcatgtatgatgc

SEQ ID NO: 741543 - DNA, 25 bp, Artificial sequence
  Synthetic oligonucleotide
aacctcagctcaacatgtatgatgc

SEQ ID NO: 741544 - DNA, 25 bp, Artificial sequence
  Synthetic oligonucleotide
attgtgagcgtatttgctgtcagaa

SEQ ID NO: 741545 - DNA, 25 bp, Artificial sequence
  Synthetic oligonucleotide
ctgcgatactgatgatgcaccgcta

SEQ ID NO: 741546 - DNA, 25 bp, Artificial sequence
  Synthetic oligonucleotide
attgtgagcgtaattgctgtcagaa

SEQ ID NO: 741547 - DNA, 25 bp, Artificial sequence
  Synthetic oligonucleotide
gcgatactgaagatgcaccgctata

SEQ ID NO: 741548 - DNA, 25 bp, Artificial sequence
  Synthetic oligonucleotide
gcgatactgaagttgcaccgctata

SEQ ID NO: 741549 - DNA, 25 bp, Artificial sequence
  Synthetic oligonucleotide
gctgctcgttctgaatgcgagcgag

SEQ ID NO: 741550 - DNA, 25 bp, Artificial sequence
  Synthetic oligonucleotide
gctgctcgttctcaatgcgagcgag

SEQ ID NO: 741551 - DNA, 25 bp, Artificial sequence
  Synthetic oligonucleotide
cctctacattgaaagcagatagtct

SEQ ID NO: 741552 - DNA, 25 bp, Artificial sequence
  Synthetic oligonucleotide
cctctacattgatagcagatagtct

SEQ ID NO: 741553 - DNA, 25 bp, Artificial sequence
  Synthetic oligonucleotide
atagcagatagtgtaacgggatagc

SEQ ID NO: 741554 - DNA, 25 bp, Artificial sequence
  Synthetic oligonucleotide
atagcagatagtctaacgggatagc

SEQ ID NO: 741555 - DNA, 25 bp, Artificial sequence
  Synthetic oligonucleotide
gatagtctaacgcgatagcataggt

SEQ ID NO: 741556 - DNA, 25 bp, Artificial sequence
  Synthetic oligonucleotide
gcataggtgcaaggctcctagcatg

SEQ ID NO: 741557 - DNA, 25 bp, Artificial sequence
  Synthetic oligonucleotide
tacagcgatatagcctggattgtga

SEQ ID NO: 741558 - DNA, 25 bp, Artificial sequence
  Synthetic oligonucleotide
gatagtctaacgggatagcataggt

SEQ ID NO: 741559 - DNA, 25 bp, Artificial sequence
  Synthetic oligonucleotide
gctgctcgttctgaatgcgagcgag

SEQ ID NO: 741560 - DNA, 25 bp, Artificial sequence
  Synthetic oligonucleotide
accatcctgcgatactgaagatgca

SEQ ID NO: 741561 - DNA, 25 bp, Artificial sequence
  Synthetic oligonucleotide
gcataggtgcaaggctcctagcatg

SEQ ID NO: 741562 - DNA, 25 bp, Artificial sequence
  Synthetic oligonucleotide
cctctacattgaaagcagatagtct

SEQ ID NO: 741563 - DNA, 25 bp, Artificial sequence
  Synthetic oligonucleotide
tacagcgatataccctggattgtga

SEQ ID NO: 741564 - DNA, 25 bp, Artificial sequence
  Synthetic oligonucleotide
tacagcgatatagcctggattgtga

SEQ ID NO: 741565 - DNA, 25 bp, Artificial sequence
  Synthetic oligonucleotide
attgtgagcgtaattgctgtcagaa

SEQ ID NO: 741566 - DNA, 25 bp, Artificial sequence
  Synthetic oligonucleotide
attgtgagcgtatttgctgtcagaa

SEQ ID NO: 741567 - DNA, 25 bp, Artificial sequence
  Synthetic oligonucleotide
aacctcagctcaacatgtatgatgc

SEQ ID NO: 741568 - DNA, 25 bp, Artificial sequence
  Synthetic oligonucleotide
accatcctgcgaaactgaagatgca

SEQ ID NO: 741569 - DNA, 25 bp, Artificial sequence
  Synthetic oligonucleotide
ctgcgatactgaagatgcaccgcta

SEQ ID NO: 741570 - DNA, 25 bp, Artificial sequence
  Synthetic oligonucleotide
atagcagatagtctaacgggatagc

SEQ ID NO: 741571 - DNA, 25 bp, Artificial sequence
  Synthetic oligonucleotide
gcataggtgcaacgctcctagcatg

SEQ ID NO: 741572 - DNA, 25 bp, Artificial sequence
  Synthetic oligonucleotide
aacctcagctcatcatgtatgatgc

SEQ ID NO: 741573 - DNA, 25 bp, Artificial sequence
  Synthetic oligonucleotide
gatagtctaacgggatagcataggt

SEQ ID NO: 741574 - DNA, 25 bp, Artificial sequence
  Synthetic oligonucleotide
ctgcgatactgatgatgcaccgcta

SEQ ID NO: 741575 - DNA, 25 bp, Artificial sequence
  Synthetic oligonucleotide
atagcagatagtgtaacgggatagc

SEQ ID NO: 741576 - DNA, 25 bp, Artificial sequence
  Synthetic oligonucleotide
cctctacattgatagcagatagtct

SEQ ID NO: 741577 - DNA, 25 bp, Artificial sequence
  Synthetic oligonucleotide
gctgctcgttctcaatgcgagcgag

SEQ ID NO: 741578 - DNA, 25 bp, Artificial sequence
  Synthetic oligonucleotide
gcgatactgaagttgcaccgctata

SEQ ID NO: 741579 - DNA, 25 bp, Artificial sequence
  Synthetic oligonucleotide
gcgatactgaagatgcaccgctata

SEQ ID NO: 741580 - DNA, 25 bp, Artificial sequence
  Synthetic oligonucleotide
gatagtctaacgcgatagcataggt

SEQ ID NO: 741581 - DNA, 25 bp, Artificial sequence
  Synthetic oligonucleotide
tattgttcctgtcgctatggatttc

SEQ ID NO: 741582 - DNA, 25 bp, Artificial sequence
  Synthetic oligonucleotide
gcgtcacaacaatatcacactcaga

SEQ ID NO: 741583 - DNA, 25 bp, Artificial sequence
  Synthetic oligonucleotide
cacgtcgacggcaaagactatgagg

SEQ ID NO: 741584 - DNA, 25 bp, Artificial sequence
  Synthetic oligonucleotide
cacgtcgacggctaagactatgagg

SEQ ID NO: 741585 - DNA, 25 bp, Artificial sequence
  Synthetic oligonucleotide
tgtcggagtttcgtaccggattact

SEQ ID NO: 741586 - DNA, 25 bp, Artificial sequence
  Synthetic oligonucleotide
tgtcggagtttcctaccggattact

SEQ ID NO: 741587 - DNA, 25 bp, Artificial sequence
  Synthetic oligonucleotide
ccgtatctttacctcatcactaacg

SEQ ID NO: 741588 - DNA, 25 bp, Artificial sequence
  Synthetic oligonucleotide
ccgtatctttacgtcatcactaacg

SEQ ID NO: 741589 - DNA, 25 bp, Artificial sequence
  Synthetic oligonucleotide
ggcgacaataagattcagactgatc

SEQ ID NO: 741590 - DNA, 25 bp, Artificial sequence
  Synthetic oligonucleotide
tattttgagctcattcctcacgtgg

SEQ ID NO: 741591 - DNA, 25 bp, Artificial sequence
  Synthetic oligonucleotide
tccaagaagctcctctaaggcgacg

SEQ ID NO: 741592 - DNA, 25 bp, Artificial sequence
  Synthetic oligonucleotide
tattgttcctgtggctatggatttc

SEQ ID NO: 741593 - DNA, 25 bp, Artificial sequence
  Synthetic oligonucleotide
tctactggcgtcgtagccacggcta

SEQ ID NO: 741594 - DNA, 25 bp, Artificial sequence
  Synthetic oligonucleotide
tctactggcgtcctagccacggcta

SEQ ID NO: 741595 - DNA, 25 bp, Artificial sequence
  Synthetic oligonucleotide
cgagaaaatggcgtcgtggatgaaa

SEQ ID NO: 741596 - DNA, 25 bp, Artificial sequence
  Synthetic oligonucleotide
cgagaaaatggcctcgtggatgaaa

SEQ ID NO: 741597 - DNA, 25 bp, Artificial sequence
  Synthetic oligonucleotide
caagagatagagagagtaacagtga

SEQ ID NO: 741598 - DNA, 25 bp, Artificial sequence
  Synthetic oligonucleotide
tacttgattgtcgttatataaacca

SEQ ID NO: 741599 - DNA, 25 bp, Artificial sequence
  Synthetic oligonucleotide
tattttgagctctttcctcacgtgg

SEQ ID NO: 741600 - DNA, 25 bp, Artificial sequence
  Synthetic oligonucleotide
gaagaagtgtattattgtggtgagc

SEQ ID NO: 741601 - DNA, 25 bp, Artificial sequence
  Synthetic oligonucleotide
taaggtgacgtcatccgaatttaga

SEQ ID NO: 741602 - DNA, 25 bp, Artificial sequence
  Synthetic oligonucleotide
taaggtgacgtcttccgaatttaga

SEQ ID NO: 741603 - DNA, 25 bp, Artificial sequence
  Synthetic oligonucleotide
caccagcaggtattttaatttagat

SEQ ID NO: 741604 - DNA, 25 bp, Artificial sequence
  Synthetic oligonucleotide
caccagcaggtaatttaatttagat

SEQ ID NO: 741605 - DNA, 25 bp, Artificial sequence
  Synthetic oligonucleotide
taggatcggccataagaaaccggtg

SEQ ID NO: 741606 - DNA, 25 bp, Artificial sequence
  Synthetic oligonucleotide
taggatcggccaaaagaaaccggtg

SEQ ID NO: 741607 - DNA, 25 bp, Artificial sequence
  Synthetic oligonucleotide
tcaacctccggtcgagaagcctctt

SEQ ID NO: 741608 - DNA, 25 bp, Artificial sequence
  Synthetic oligonucleotide
ggcgacaataagtttcagactgatc

SEQ ID NO: 741609 - DNA, 25 bp, Artificial sequence
  Synthetic oligonucleotide
gaagaagtgtataattgtggtgagc

SEQ ID NO: 741610 - DNA, 25 bp, Artificial sequence
  Synthetic oligonucleotide
gcgtcacaacaaaatcacactcaga

SEQ ID NO: 741611 - DNA, 25 bp, Artificial sequence
  Synthetic oligonucleotide
aagagaaggagaggccggcgacggt

SEQ ID NO: 741612 - DNA, 25 bp, Artificial sequence
  Synthetic oligonucleotide
aagagaaggagacgccggcgacggt

SEQ ID NO: 741613 - DNA, 25 bp, Artificial sequence
  Synthetic oligonucleotide
tgcagatcgttaaggagccggaggt

SEQ ID NO: 741614 - DNA, 25 bp, Artificial sequence
  Synthetic oligonucleotide
tgcagatcgttatggagccggaggt

SEQ ID NO: 741615 - DNA, 25 bp, Artificial sequence
  Synthetic oligonucleotide
gatgcggattttcgtttcatcggca

SEQ ID NO: 741616 - DNA, 25 bp, Artificial sequence
  Synthetic oligonucleotide
gatgcggattttggtttcatcggca

SEQ ID NO: 741617 - DNA, 25 bp, Artificial sequence
  Synthetic oligonucleotide
tccaagaagctcgtctaaggcgacg

SEQ ID NO: 741618 - DNA, 25 bp, Artificial sequence
  Synthetic oligonucleotide
tcaacctccggtggagaagcctctt

SEQ ID NO: 741619 - DNA, 25 bp, Artificial sequence
  Synthetic oligonucleotide
taatctataaaacaacatataaact

SEQ ID NO: 741620 - DNA, 25 bp, Artificial sequence
  Synthetic oligonucleotide
caagagatagagtgagtaacagtga

SEQ ID NO: 741621 - DNA, 25 bp, Artificial sequence
  Synthetic oligonucleotide
gcataacgtgtgtttgggaaaccat

SEQ ID NO: 741622 - DNA, 25 bp, Artificial sequence
  Synthetic oligonucleotide
gcataacgtgtgattgggaaaccat

SEQ ID NO: 741623 - DNA, 25 bp, Artificial sequence
  Synthetic oligonucleotide
taaaagtaaacatacatgcaaggct

SEQ ID NO: 741624 - DNA, 25 bp, Artificial sequence
  Synthetic oligonucleotide
taaaagtaaacaaacatgcaaggct

SEQ ID NO: 741625 - DNA, 25 bp, Artificial sequence
  Synthetic oligonucleotide
ttgtctaaaatttacataaaaccca

SEQ ID NO: 741626 - DNA, 25 bp, Artificial sequence
  Synthetic oligonucleotide
ttgtctaaaattaacataaaaccca

SEQ ID NO: 741627 - DNA, 25 bp, Artificial sequence
  Synthetic oligonucleotide
ggaattataacgaatggccatacta

SEQ ID NO: 741628 - DNA, 25 bp, Artificial sequence
  Synthetic oligonucleotide
gtaattagttatgaattcgctcaaa

SEQ ID NO: 741629 - DNA, 25 bp, Artificial sequence
  Synthetic oligonucleotide
gaattattatttgacgtatataaga

SEQ ID NO: 741630 - DNA, 25 bp, Artificial sequence
  Synthetic oligonucleotide
taatctataaaagaacatataaact

SEQ ID NO: 741631 - DNA, 25 bp, Artificial sequence
  Synthetic oligonucleotide
ggtttttaacaacgctttacatcca

SEQ ID NO: 741632 - DNA, 25 bp, Artificial sequence
  Synthetic oligonucleotide
ggtttttaacaaggctttacatcca

SEQ ID NO: 741633 - DNA, 25 bp, Artificial sequence
  Synthetic oligonucleotide
tccatcttagatattttacaactct

SEQ ID NO: 741634 - DNA, 25 bp, Artificial sequence
  Synthetic oligonucleotide
tccatcttagattttttacaactct

SEQ ID NO: 741635 - DNA, 25 bp, Artificial sequence
  Synthetic oligonucleotide
tactatactttattacttgttaagt

SEQ ID NO: 741636 - DNA, 25 bp, Artificial sequence
  Synthetic oligonucleotide
tactatactttaatacttgttaagt

SEQ ID NO: 741637 - DNA, 25 bp, Artificial sequence
  Synthetic oligonucleotide
gtaattagttatcaattcgctcaaa

SEQ ID NO: 741638 - DNA, 25 bp, Artificial sequence
  Synthetic oligonucleotide
tctactcttgttatgtttatacaag

SEQ ID NO: 741639 - DNA, 25 bp, Artificial sequence
  Synthetic oligonucleotide
gaaagaataatacagtcagagctaa

SEQ ID NO: 741640 - DNA, 25 bp, Artificial sequence
  Synthetic oligonucleotide
gaaagaataatagagtcagagctaa

SEQ ID NO: 741641 - DNA, 25 bp, Artificial sequence
  Synthetic oligonucleotide
cattgtcccctcacatagctttcta

SEQ ID NO: 741642 - DNA, 25 bp, Artificial sequence
  Synthetic oligonucleotide
cattgtcccctctcatagctttcta

SEQ ID NO: 741643 - DNA, 25 bp, Artificial sequence
  Synthetic oligonucleotide
tctattcttagatccaacggtatgt

SEQ ID NO: 741644 - DNA, 25 bp, Artificial sequence
  Synthetic oligonucleotide
tctattcttagaaccaacggtatgt

SEQ ID NO: 741645 - DNA, 25 bp, Artificial sequence
  Synthetic oligonucleotide
atctactgcccctaaacaatcctga

SEQ ID NO: 741646 - DNA, 25 bp, Artificial sequence
  Synthetic oligonucleotide
ggaattataacgtatggccatacta

SEQ ID NO: 741647 - DNA, 25 bp, Artificial sequence
  Synthetic oligonucleotide
tctactcttgttttgtttatacaag

SEQ ID NO: 741648 - DNA, 25 bp, Artificial sequence
  Synthetic oligonucleotide
gcgttgagagttgcgaaaccgaaac

SEQ ID NO: 741649 - DNA, 25 bp, Artificial sequence
  Synthetic oligonucleotide
aataagacataatcaacaacaaaaa

SEQ ID NO: 741650 - DNA, 25 bp, Artificial sequence
  Synthetic oligonucleotide
aataagacataaacaacaacaaaaa

SEQ ID NO: 741651 - DNA, 25 bp, Artificial sequence
  Synthetic oligonucleotide
cacgtgaagcttagagtacgtgtca

SEQ ID NO: 741652 - DNA, 25 bp, Artificial sequence
  Synthetic oligonucleotide
cacgtgaagctttgagtacgtgtca

SEQ ID NO: 741653 - DNA, 25 bp, Artificial sequence
  Synthetic oligonucleotide
caattatgggattaaattaagagac

SEQ ID NO: 741654 - DNA, 25 bp, Artificial sequence
  Synthetic oligonucleotide
caattatgggataaaattaagagac

SEQ ID NO: 741655 - DNA, 25 bp, Artificial sequence
  Synthetic oligonucleotide
gaattattatttcacgtatataaga

SEQ ID NO: 741656 - DNA, 25 bp, Artificial sequence
  Synthetic oligonucleotide
atctactgccccaaaacaatcctga

SEQ ID NO: 741657 - DNA, 25 bp, Artificial sequence
  Synthetic oligonucleotide
tctcatcttagcatcagtttctcca

SEQ ID NO: 741658 - DNA, 25 bp, Artificial sequence
  Synthetic oligonucleotide
taatttcgtaatttttcagaaagga

SEQ ID NO: 741659 - DNA, 25 bp, Artificial sequence
  Synthetic oligonucleotide
ggactattccctgtgcaacacataa

SEQ ID NO: 741660 - DNA, 25 bp, Artificial sequence
  Synthetic oligonucleotide
gacttaattaatcccaatcccacca

SEQ ID NO: 741661 - DNA, 25 bp, Artificial sequence
  Synthetic oligonucleotide
aagctgatccacgtccaaccagaaa

SEQ ID NO: 741662 - DNA, 25 bp, Artificial sequence
  Synthetic oligonucleotide
tcatctcaagacatacaagcacatt

SEQ ID NO: 741663 - DNA, 25 bp, Artificial sequence
  Synthetic oligonucleotide
tcatctcaagacttacaagcacatt

SEQ ID NO: 741664 - DNA, 25 bp, Artificial sequence
  Synthetic oligonucleotide
cgtgaaaagcgttctgttgaatgat

SEQ ID NO: 741665 - DNA, 25 bp, Artificial sequence
  Synthetic oligonucleotide
taagaatggaactaggcgaaaaatt

SEQ ID NO: 741666 - DNA, 25 bp, Artificial sequence
  Synthetic oligonucleotide
tctcatcttagcttcagtttctcca

SEQ ID NO: 741667 - DNA, 25 bp, Artificial sequence
  Synthetic oligonucleotide
taagaatggaacaaggcgaaaaatt

SEQ ID NO: 741668 - DNA, 25 bp, Artificial sequence
  Synthetic oligonucleotide
gaaagagtctgctctctcagaatca

SEQ ID NO: 741669 - DNA, 25 bp, Artificial sequence
  Synthetic oligonucleotide
gaaagagtctgcactctcagaatca

SEQ ID NO: 741670 - DNA, 25 bp, Artificial sequence
  Synthetic oligonucleotide
aaagaagaagattagatcttctctg

SEQ ID NO: 741671 - DNA, 25 bp, Artificial sequence
  Synthetic oligonucleotide
aaagaagaagataagatcttctctg

SEQ ID NO: 741672 - DNA, 25 bp, Artificial sequence
  Synthetic oligonucleotide
tagtggtaacataacaacattaaca

SEQ ID NO: 741673 - DNA, 25 bp, Artificial sequence
  Synthetic oligonucleotide
tagtggtaacattacaacattaaca

SEQ ID NO: 741674 - DNA, 25 bp, Artificial sequence
  Synthetic oligonucleotide
aacaaataaacataggtacattatc

SEQ ID NO: 741675 - DNA, 25 bp, Artificial sequence
  Synthetic oligonucleotide
cgtgaaaagcgtactgttgaatgat

SEQ ID NO: 741676 - DNA, 25 bp, Artificial sequence
  Synthetic oligonucleotide
gacttagattaacgagaaaaatctc

SEQ ID NO: 741677 - DNA, 25 bp, Artificial sequence
  Synthetic oligonucleotide
tacttgattgtccttatataaacca

SEQ ID NO: 741678 - DNA, 25 bp, Artificial sequence
  Synthetic oligonucleotide
aaagtagtcctgcaaaccttaatgg

SEQ ID NO: 741679 - DNA, 25 bp, Artificial sequence
  Synthetic oligonucleotide
aaagtagtcctggaaaccttaatgg

SEQ ID NO: 741680 - DNA, 25 bp, Artificial sequence
  Synthetic oligonucleotide
tctgttgttgaggtggcaaagctac

SEQ ID NO: 741681 - DNA, 25 bp, Artificial sequence
  Synthetic oligonucleotide
tctgttgttgagctggcaaagctac

SEQ ID NO: 741682 - DNA, 25 bp, Artificial sequence
  Synthetic oligonucleotide
aaaccttcagctgtcaactaaatag

SEQ ID NO: 741683 - DNA, 25 bp, Artificial sequence
  Synthetic oligonucleotide
aaaccttcagctctcaactaaatag

SEQ ID NO: 741684 - DNA, 25 bp, Artificial sequence
  Synthetic oligonucleotide
ggactattccctctgcaacacataa

SEQ ID NO: 741685 - DNA, 25 bp, Artificial sequence
  Synthetic oligonucleotide
tatgcacattactaaaatcctagac

SEQ ID NO: 741686 - DNA, 25 bp, Artificial sequence
  Synthetic oligonucleotide
caatctactttaaaatgctctttct

SEQ ID NO: 741687 - DNA, 25 bp, Artificial sequence
  Synthetic oligonucleotide
gacttagattaaggagaaaaatctc

SEQ ID NO: 741688 - DNA, 25 bp, Artificial sequence
  Synthetic oligonucleotide
caagctctaaacggttttcgttcgc

SEQ ID NO: 741689 - DNA, 25 bp, Artificial sequence
  Synthetic oligonucleotide
caagctctaaaccgttttcgttcgc

SEQ ID NO: 741690 - DNA, 25 bp, Artificial sequence
  Synthetic oligonucleotide
tattgagatgagtcttttttgtgtc

SEQ ID NO: 741691 - DNA, 25 bp, Artificial sequence
  Synthetic oligonucleotide
tattgagatgagacttttttgtgtc

SEQ ID NO: 741692 - DNA, 25 bp, Artificial sequence
  Synthetic oligonucleotide
ttaaacttgaccgaatgtagcagtg

SEQ ID NO: 741693 - DNA, 25 bp, Artificial sequence
  Synthetic oligonucleotide
ttaaacttgacccaatgtagcagtg

SEQ ID NO: 741694 - DNA, 25 bp, Artificial sequence
  Synthetic oligonucleotide
tatgcacattacaaaaatcctagac

SEQ ID NO: 741695 - DNA, 25 bp, Artificial sequence
  Synthetic oligonucleotide
tattacaagagagccgacacgttcg

SEQ ID NO: 741696 - DNA, 25 bp, Artificial sequence
  Synthetic oligonucleotide
tgagcttaaccgcaaagtagaagcg

SEQ ID NO: 741697 - DNA, 25 bp, Artificial sequence
  Synthetic oligonucleotide
aaggtgaagaaggtgaaagtgtcac

SEQ ID NO: 741698 - DNA, 25 bp, Artificial sequence
  Synthetic oligonucleotide
aaggtgaagaagctgaaagtgtcac

SEQ ID NO: 741699 - DNA, 25 bp, Artificial sequence
  Synthetic oligonucleotide
ttaccagtctctcccgccgccacct

SEQ ID NO: 741700 - DNA, 25 bp, Artificial sequence
  Synthetic oligonucleotide
ttaccagtctctgccgccgccacct

SEQ ID NO: 741701 - DNA, 25 bp, Artificial sequence
  Synthetic oligonucleotide
aatcggagacgtttagtgacagaac

SEQ ID NO: 741702 - DNA, 25 bp, Artificial sequence
  Synthetic oligonucleotide
aatcggagacgtatagtgacagaac

SEQ ID NO: 741703 - DNA, 25 bp, Artificial sequence
  Synthetic oligonucleotide
aacaaataaacaaaggtacattatc

SEQ ID NO: 741704 - DNA, 25 bp, Artificial sequence
  Synthetic oligonucleotide
gcgaagagacaaaacaatcaggtgt

SEQ ID NO: 741705 - DNA, 25 bp, Artificial sequence
  Synthetic oligonucleotide
aaaatgcaacgacgagaggttcgcg

SEQ ID NO: 741706 - DNA, 25 bp, Artificial sequence
  Synthetic oligonucleotide
tattacaagagacccgacacgttcg

SEQ ID NO: 741707 - DNA, 25 bp, Artificial sequence
  Synthetic oligonucleotide
aggcaacaagtcaacgcttccgttg

SEQ ID NO: 741708 - DNA, 25 bp, Artificial sequence
  Synthetic oligonucleotide
aggcaacaagtctacgcttccgttg

SEQ ID NO: 741709 - DNA, 25 bp, Artificial sequence
  Synthetic oligonucleotide
cgttagagaataggtggaagatgat

SEQ ID NO: 741710 - DNA, 25 bp, Artificial sequence
  Synthetic oligonucleotide
cgttagagaatacgtggaagatgat

SEQ ID NO: 741711 - DNA, 25 bp, Artificial sequence
  Synthetic oligonucleotide
gcgttgagagttccgaaaccgaaac

SEQ ID NO: 741712 - DNA, 25 bp, Artificial sequence
  Synthetic oligonucleotide
aagctgatccacctccaaccagaaa

SEQ ID NO: 741713 - DNA, 25 bp, Artificial sequence
  Synthetic oligonucleotide
gcgaagagacaatacaatcaggtgt

SEQ ID NO: 741714 - DNA, 25 bp, Artificial sequence
  Synthetic oligonucleotide
gtcacggataaagaaaatctctgct

SEQ ID NO: 741715 - DNA, 25 bp, Artificial sequence
  Synthetic oligonucleotide
taatttcgtaatatttcagaaagga

SEQ ID NO: 741716 - DNA, 25 bp, Artificial sequence
  Synthetic oligonucleotide
caaagatattagataatgggaacac

SEQ ID NO: 741717 - DNA, 25 bp, Artificial sequence
  Synthetic oligonucleotide
caaagatattagttaatgggaacac

SEQ ID NO: 741718 - DNA, 25 bp, Artificial sequence
  Synthetic oligonucleotide
ttgaatagatatattctcctctgcg

SEQ ID NO: 741719 - DNA, 25 bp, Artificial sequence
  Synthetic oligonucleotide
ttgaatagatattttctcctctgcg

SEQ ID NO: 741720 - DNA, 25 bp, Artificial sequence
  Synthetic oligonucleotide
tagtgatatttcttcttcgttaaca

SEQ ID NO: 741721 - DNA, 25 bp, Artificial sequence
  Synthetic oligonucleotide
tagtgatatttcatcttcgttaaca

SEQ ID NO: 741722 - DNA, 25 bp, Artificial sequence
  Synthetic oligonucleotide
tgagcttaaccggaaagtagaagcg

SEQ ID NO: 741723 - DNA, 25 bp, Artificial sequence
  Synthetic oligonucleotide
tattgattggataagggtggaattg

SEQ ID NO: 741724 - DNA, 25 bp, Artificial sequence
  Synthetic oligonucleotide
aaaatgcaacgaggagaggttcgcg

SEQ ID NO: 741725 - DNA, 25 bp, Artificial sequence
  Synthetic oligonucleotide
gtcacggataaacaaaatctctgct

SEQ ID NO: 741726 - DNA, 25 bp, Artificial sequence
  Synthetic oligonucleotide
caatacacgacattaacaagttaac

SEQ ID NO: 741727 - DNA, 25 bp, Artificial sequence
  Synthetic oligonucleotide
caatacacgacaataacaagttaac

SEQ ID NO: 741728 - DNA, 25 bp, Artificial sequence
  Synthetic oligonucleotide
atcattttcttcataatttttttgg

SEQ ID NO: 741729 - DNA, 25 bp, Artificial sequence
  Synthetic oligonucleotide
atcattttcttcttaatttttttgg

SEQ ID NO: 741730 - DNA, 25 bp, Artificial sequence
  Synthetic oligonucleotide
tggacaacgaagaggctcgtcatgg

SEQ ID NO: 741731 - DNA, 25 bp, Artificial sequence
  Synthetic oligonucleotide
tggacaacgaagtggctcgtcatgg

SEQ ID NO: 741732 - DNA, 25 bp, Artificial sequence
  Synthetic oligonucleotide
caatctactttataatgctctttct

SEQ ID NO: 741733 - DNA, 25 bp, Artificial sequence
  Synthetic oligonucleotide
tattgattggattagggtggaattg

SEQ ID NO: 741734 - DNA, 25 bp, Artificial sequence
  Synthetic oligonucleotide
gacttaattaatgccaatcccacca

SEQ ID NO: 741735 - DNA, 25 bp, Artificial sequence
  Synthetic oligonucleotide
caagccgttttttaaattatgtgag

SEQ ID NO: 741736 - DNA, 25 bp, Artificial sequence
  Synthetic oligonucleotide
tttctaaaaacaattcaatgatatg

SEQ ID NO: 741737 - DNA, 25 bp, Artificial sequence
  Synthetic oligonucleotide
caagccgtttttaaaattatgtgag

SEQ ID NO: 741738 - DNA, 25 bp, Artificial sequence
  Synthetic oligonucleotide
caactagagattttacactataaac

SEQ ID NO: 741739 - DNA, 25 bp, Artificial sequence
  Synthetic oligonucleotide
caactagagattatacactataaac

SEQ ID NO: 741740 - DNA, 25 bp, Artificial sequence
  Synthetic oligonucleotide
tatgagtaaaatacttaacaattta

SEQ ID NO: 741741 - DNA, 25 bp, Artificial sequence
  Synthetic oligonucleotide
tatgagtaaaattcttaacaattta

SEQ ID NO: 741742 - DNA, 25 bp, Artificial sequence
  Synthetic oligonucleotide
gattaatttgttatgtggtaggata

SEQ ID NO: 741743 - DNA, 25 bp, Artificial sequence
  Synthetic oligonucleotide
gattaatttgttttgtggtaggata

SEQ ID NO: 741744 - DNA, 25 bp, Artificial sequence
  Synthetic oligonucleotide
gaatttaatgtcattttcttgtaac

SEQ ID NO: 741745 - DNA, 25 bp, Artificial sequence
  Synthetic oligonucleotide
tttctaaaaacatttcaatgatatg

SEQ ID NO: 741746 - DNA, 25 bp, Artificial sequence
  Synthetic oligonucleotide
gaatttaatgtctttttcttgtaac

SEQ ID NO: 741747 - DNA, 25 bp, Artificial sequence
  Synthetic oligonucleotide
tcgatatggctgatcactgtaagta

SEQ ID NO: 741748 - DNA, 25 bp, Artificial sequence
  Synthetic oligonucleotide
gtttctcgccgttgaactatctcca

SEQ ID NO: 741749 - DNA, 25 bp, Artificial sequence
  Synthetic oligonucleotide
gatggtcctgctcaagatctttacg

SEQ ID NO: 741750 - DNA, 25 bp, Artificial sequence
  Synthetic oligonucleotide
gatggtcctgctgaagatctttacg

SEQ ID NO: 741751 - DNA, 25 bp, Artificial sequence
  Synthetic oligonucleotide
agagttgtgcttagtttgttttcta

SEQ ID NO: 741752 - DNA, 25 bp, Artificial sequence
  Synthetic oligonucleotide
agagttgtgctttgtttgttttcta

SEQ ID NO: 741753 - DNA, 25 bp, Artificial sequence
  Synthetic oligonucleotide
cacagaagaattcaattgtgtggag

SEQ ID NO: 741754 - DNA, 25 bp, Artificial sequence
  Synthetic oligonucleotide
cacagaagaattgaattgtgtggag

SEQ ID NO: 741755 - DNA, 25 bp, Artificial sequence
  Synthetic oligonucleotide
cttgatgaccttcaatgtgtggagc

SEQ ID NO: 741756 - DNA, 25 bp, Artificial sequence
  Synthetic oligonucleotide
cttgatgaccttgaatgtgtggagc

SEQ ID NO: 741757 - DNA, 25 bp, Artificial sequence
  Synthetic oligonucleotide
gtggagattagttatagaactgtgc

SEQ ID NO: 741758 - DNA, 25 bp, Artificial sequence
  Synthetic oligonucleotide
gtggagattagtaatagaactgtgc

SEQ ID NO: 741759 - DNA, 25 bp, Artificial sequence
  Synthetic oligonucleotide
aattgaatattcagaattgacttga

SEQ ID NO: 741760 - DNA, 25 bp, Artificial sequence
  Synthetic oligonucleotide
cttggagaagattaaagggtaagca

SEQ ID NO: 741761 - DNA, 25 bp, Artificial sequence
  Synthetic oligonucleotide
tcgatatggctgttcactgtaagta

SEQ ID NO: 741762 - DNA, 25 bp, Artificial sequence
  Synthetic oligonucleotide
caatgcttcgtttcgccgatgctgg

SEQ ID NO: 741763 - DNA, 25 bp, Artificial sequence
  Synthetic oligonucleotide
caatgcttcgttacgccgatgctgg

SEQ ID NO: 741764 - DNA, 25 bp, Artificial sequence
  Synthetic oligonucleotide
atgggggaagattgatcgaaacgac

SEQ ID NO: 741765 - DNA, 25 bp, Artificial sequence
  Synthetic oligonucleotide
atgggggaagatagatcgaaacgac

SEQ ID NO: 741766 - DNA, 25 bp, Artificial sequence
  Synthetic oligonucleotide
tatgcagagttcacaacgggatgtg

SEQ ID NO: 741767 - DNA, 25 bp, Artificial sequence
  Synthetic oligonucleotide
tatgcagagttctcaacgggatgtg

SEQ ID NO: 741768 - DNA, 25 bp, Artificial sequence
  Synthetic oligonucleotide
tcggtgaaactgtagaacgggaacg

SEQ ID NO: 741769 - DNA, 25 bp, Artificial sequence
  Synthetic oligonucleotide
tcggtgaaactgaagaacgggaacg

SEQ ID NO: 741770 - DNA, 25 bp, Artificial sequence
  Synthetic oligonucleotide
tgaattgttcggaggagattacgga

SEQ ID NO: 741771 - DNA, 25 bp, Artificial sequence
  Synthetic oligonucleotide
tgactaattttgatacagagagact

SEQ ID NO: 741772 - DNA, 25 bp, Artificial sequence
  Synthetic oligonucleotide
aattgaatattctgaattgacttga

SEQ ID NO: 741773 - DNA, 25 bp, Artificial sequence
  Synthetic oligonucleotide
ggtgtgtgttacactcgtcgcttaa

SEQ ID NO: 741774 - DNA, 25 bp, Artificial sequence
  Synthetic oligonucleotide
caattcgtatctattttaaagttaa

SEQ ID NO: 741775 - DNA, 25 bp, Artificial sequence
  Synthetic oligonucleotide
tattgaaatgctttcagggaaaatc

SEQ ID NO: 741776 - DNA, 25 bp, Artificial sequence
  Synthetic oligonucleotide
tctatttgtttaactattgggctgc

SEQ ID NO: 741777 - DNA, 25 bp, Artificial sequence
  Synthetic oligonucleotide
tctatttgtttatctattgggctgc

SEQ ID NO: 741778 - DNA, 25 bp, Artificial sequence
  Synthetic oligonucleotide
gcgagaggggctttatctttctcct

SEQ ID NO: 741779 - DNA, 25 bp, Artificial sequence
  Synthetic oligonucleotide
gcgagaggggctatatctttctcct

SEQ ID NO: 741780 - DNA, 25 bp, Artificial sequence
  Synthetic oligonucleotide
tgcactgaaacatctcacagacttg

SEQ ID NO: 741781 - DNA, 25 bp, Artificial sequence
  Synthetic oligonucleotide
tgcactgaaacaactcacagacttg

SEQ ID NO: 741782 - DNA, 25 bp, Artificial sequence
  Synthetic oligonucleotide
gaataggtgggattatgcgaatgac

SEQ ID NO: 741783 - DNA, 25 bp, Artificial sequence
  Synthetic oligonucleotide
gaataggtgggaatatgcgaatgac

SEQ ID NO: 741784 - DNA, 25 bp, Artificial sequence
  Synthetic oligonucleotide
gacgtttcctatcttcttgctaaag

SEQ ID NO: 741785 - DNA, 25 bp, Artificial sequence
  Synthetic oligonucleotide
caatagagttcgacgagagcgtcca

SEQ ID NO: 741786 - DNA, 25 bp, Artificial sequence
  Synthetic oligonucleotide
ggtgtgtgttactctcgtcgcttaa

SEQ ID NO: 741787 - DNA, 25 bp, Artificial sequence
  Synthetic oligonucleotide
caatagagttcgtcgagagcgtcca

SEQ ID NO: 741788 - DNA, 25 bp, Artificial sequence
  Synthetic oligonucleotide
gatgtggctgctgttgatatgcttc

SEQ ID NO: 741789 - DNA, 25 bp, Artificial sequence
  Synthetic oligonucleotide
gatgtggctgctcttgatatgcttc

SEQ ID NO: 741790 - DNA, 25 bp, Artificial sequence
  Synthetic oligonucleotide
gttcgtcagaacatcgatatatcga

SEQ ID NO: 741791 - DNA, 25 bp, Artificial sequence
  Synthetic oligonucleotide
gttcgtcagaacttcgatatatcga

SEQ ID NO: 741792 - DNA, 25 bp, Artificial sequence
  Synthetic oligonucleotide
tgggtgcctcctgcaataaagatga

SEQ ID NO: 741793 - DNA, 25 bp, Artificial sequence
  Synthetic oligonucleotide
tgggtgcctcctccaataaagatga

SEQ ID NO: 741794 - DNA, 25 bp, Artificial sequence
  Synthetic oligonucleotide
aatggttaggctttatttaatgatg

SEQ ID NO: 741795 - DNA, 25 bp, Artificial sequence
  Synthetic oligonucleotide
aatggttaggctatatttaatgatg

SEQ ID NO: 741796 - DNA, 25 bp, Artificial sequence
  Synthetic oligonucleotide
gattagaatttgaataagatatggt

SEQ ID NO: 741797 - DNA, 25 bp, Artificial sequence
  Synthetic oligonucleotide
gattagaatttgtataagatatggt

SEQ ID NO: 741798 - DNA, 25 bp, Artificial sequence
  Synthetic oligonucleotide
cttggagaagataaaagggtaagca

SEQ ID NO: 741799 - DNA, 25 bp, Artificial sequence
  Synthetic oligonucleotide
gacgtttcctatgttcttgctaaag

SEQ ID NO: 741800 - DNA, 25 bp, Artificial sequence
  Synthetic oligonucleotide
tacatgaccaactttttgaaagaac

SEQ ID NO: 741801 - DNA, 25 bp, Artificial sequence
  Synthetic oligonucleotide
tgaattgttcggtggagattacgga

SEQ ID NO: 741802 - DNA, 25 bp, Artificial sequence
  Synthetic oligonucleotide
tacttaaacttcgaatgattgtggc

SEQ ID NO: 741803 - DNA, 25 bp, Artificial sequence
  Synthetic oligonucleotide
gtggttctaaaagaacaatctcaag

SEQ ID NO: 741804 - DNA, 25 bp, Artificial sequence
  Synthetic oligonucleotide
gtggttctaaaacaacaatctcaag

SEQ ID NO: 741805 - DNA, 25 bp, Artificial sequence
  Synthetic oligonucleotide
caaacataccttttttctaaatgta

SEQ ID NO: 741806 - DNA, 25 bp, Artificial sequence
  Synthetic oligonucleotide
caaacataccttatttctaaatgta

SEQ ID NO: 741807 - DNA, 25 bp, Artificial sequence
  Synthetic oligonucleotide
tgacaaatttagtttaacaaatagg

SEQ ID NO: 741808 - DNA, 25 bp, Artificial sequence
  Synthetic oligonucleotide
tgacaaatttagattaacaaatagg

SEQ ID NO: 741809 - DNA, 25 bp, Artificial sequence
  Synthetic oligonucleotide
gaaagaaaaacacattgaagattag

SEQ ID NO: 741810 - DNA, 25 bp, Artificial sequence
  Synthetic oligonucleotide
gaaagaaaaacagattgaagattag

SEQ ID NO: 741811 - DNA, 25 bp, Artificial sequence
  Synthetic oligonucleotide
aatattgcaatgatttacatcagcg

SEQ ID NO: 741812 - DNA, 25 bp, Artificial sequence
  Synthetic oligonucleotide
tacaaatctgtttgagatttagacc

SEQ ID NO: 741813 - DNA, 25 bp, Artificial sequence
  Synthetic oligonucleotide
tacatgaccaacattttgaaagaac

SEQ ID NO: 741814 - DNA, 25 bp, Artificial sequence
  Synthetic oligonucleotide
tacaaatctgttagagatttagacc

SEQ ID NO: 741815 - DNA, 25 bp, Artificial sequence
  Synthetic oligonucleotide
taaaaatgttacagccttacagtct

SEQ ID NO: 741816 - DNA, 25 bp, Artificial sequence
  Synthetic oligonucleotide
taaaaatgttactgccttacagtct

SEQ ID NO: 741817 - DNA, 25 bp, Artificial sequence
  Synthetic oligonucleotide
gataatttagaattcagaaaaatca

SEQ ID NO: 741818 - DNA, 25 bp, Artificial sequence
  Synthetic oligonucleotide
gataatttagaaatcagaaaaatca

SEQ ID NO: 741819 - DNA, 25 bp, Artificial sequence
  Synthetic oligonucleotide
tttccaaataaatacatatgttttc

SEQ ID NO: 741820 - DNA, 25 bp, Artificial sequence
  Synthetic oligonucleotide
tttccaaataaaaacatatgttttc

SEQ ID NO: 741821 - DNA, 25 bp, Artificial sequence
  Synthetic oligonucleotide
ccatagtagtataatacttttaaaa

SEQ ID NO: 741822 - DNA, 25 bp, Artificial sequence
  Synthetic oligonucleotide
ccatagtagtattatacttttaaaa

SEQ ID NO: 741823 - DNA, 25 bp, Artificial sequence
  Synthetic oligonucleotide
tagtaaaaattatggaataaagcta

SEQ ID NO: 741824 - DNA, 25 bp, Artificial sequence
  Synthetic oligonucleotide
tagtaaaaattaaggaataaagcta

SEQ ID NO: 741825 - DNA, 25 bp, Artificial sequence
  Synthetic oligonucleotide
caattcgtatcttttttaaagttaa

SEQ ID NO: 741826 - DNA, 25 bp, Artificial sequence
  Synthetic oligonucleotide
aatattgcaatgttttacatcagcg

SEQ ID NO: 741827 - DNA, 25 bp, Artificial sequence
  Synthetic oligonucleotide
cctaaagttacagatatagaaagcg

SEQ ID NO: 741828 - DNA, 25 bp, Artificial sequence
  Synthetic oligonucleotide
gaacctagccacaacactatcatcg

SEQ ID NO: 741829 - DNA, 25 bp, Artificial sequence
  Synthetic oligonucleotide
gaggccatgcctgtgtccgtacatt

SEQ ID NO: 741830 - DNA, 25 bp, Artificial sequence
  Synthetic oligonucleotide
gaggccatgcctctgtccgtacatt

SEQ ID NO: 741831 - DNA, 25 bp, Artificial sequence
  Synthetic oligonucleotide
ttttcctcttccaccgagagagaag

SEQ ID NO: 741832 - DNA, 25 bp, Artificial sequence
  Synthetic oligonucleotide
ttttcctcttcctccgagagagaag

SEQ ID NO: 741833 - DNA, 25 bp, Artificial sequence
  Synthetic oligonucleotide
gaattagaggcccataagccacaga

SEQ ID NO: 741834 - DNA, 25 bp, Artificial sequence
  Synthetic oligonucleotide
gaattagaggccgataagccacaga

SEQ ID NO: 741835 - DNA, 25 bp, Artificial sequence
  Synthetic oligonucleotide
tcgaagcgtggagggtctaaattaa

SEQ ID NO: 741836 - DNA, 25 bp, Artificial sequence
  Synthetic oligonucleotide
tcgaagcgtggacggtctaaattaa

SEQ ID NO: 741837 - DNA, 25 bp, Artificial sequence
  Synthetic oligonucleotide
caatcggcagtttgagttttgaggt

SEQ ID NO: 741838 - DNA, 25 bp, Artificial sequence
  Synthetic oligonucleotide
caatcggcagttagagttttgaggt

SEQ ID NO: 741839 - DNA, 25 bp, Artificial sequence
  Synthetic oligonucleotide
tacttaaacttccaatgattgtggc

SEQ ID NO: 741840 - DNA, 25 bp, Artificial sequence
  Synthetic oligonucleotide
caagatactctagatatttgctttt

SEQ ID NO: 741841 - DNA, 25 bp, Artificial sequence
  Synthetic oligonucleotide
tgactaattttgttacagagagact

SEQ ID NO: 741842 - DNA, 25 bp, Artificial sequence
  Synthetic oligonucleotide
cctaaagttacacatatagaaagcg

SEQ ID NO: 741843 - DNA, 25 bp, Artificial sequence
  Synthetic oligonucleotide
gatgtttagtccattttgcacacag

SEQ ID NO: 741844 - DNA, 25 bp, Artificial sequence
  Synthetic oligonucleotide
gatgtttagtcctttttgcacacag

SEQ ID NO: 741845 - DNA, 25 bp, Artificial sequence
  Synthetic oligonucleotide
tgcatactccaataataaaatggtt

SEQ ID NO: 741846 - DNA, 25 bp, Artificial sequence
  Synthetic oligonucleotide
tgcatactccaaaaataaaatggtt

SEQ ID NO: 741847 - DNA, 25 bp, Artificial sequence
  Synthetic oligonucleotide
caacgtaaagataaatttggtatgc

SEQ ID NO: 741848 - DNA, 25 bp, Artificial sequence
  Synthetic oligonucleotide
caacgtaaagattaatttggtatgc

SEQ ID NO: 741849 - DNA, 25 bp, Artificial sequence
  Synthetic oligonucleotide
aaaaatagaacaatatgcggcgaac

SEQ ID NO: 741850 - DNA, 25 bp, Artificial sequence
  Synthetic oligonucleotide
aaaaatagaacattatgcggcgaac

SEQ ID NO: 741851 - DNA, 25 bp, Artificial sequence
  Synthetic oligonucleotide
tcgttcaaaaacagtaatatctatt

SEQ ID NO: 741852 - DNA, 25 bp, Artificial sequence
  Synthetic oligonucleotide
tcgttcaaaaactgtaatatctatt

SEQ ID NO: 741853 - DNA, 25 bp, Artificial sequence
  Synthetic oligonucleotide
caagatactctacatatttgctttt

SEQ ID NO: 741854 - DNA, 25 bp, Artificial sequence
  Synthetic oligonucleotide
ggcaaataccacttcttattgaaaa

SEQ ID NO: 741855 - DNA, 25 bp, Artificial sequence
  Synthetic oligonucleotide
ttatgtgtagaggaatcatttttac

SEQ ID NO: 741856 - DNA, 25 bp, Artificial sequence
  Synthetic oligonucleotide
gaatccagaatacacctgttcaact

SEQ ID NO: 741857 - DNA, 25 bp, Artificial sequence
  Synthetic oligonucleotide
gaatccagaatagacctgttcaact

SEQ ID NO: 741858 - DNA, 25 bp, Artificial sequence
  Synthetic oligonucleotide
ggaacatactcatacaaatttggca

SEQ ID NO: 741859 - DNA, 25 bp, Artificial sequence
  Synthetic oligonucleotide
ggaacatactcaaacaaatttggca

SEQ ID NO: 741860 - DNA, 25 bp, Artificial sequence
  Synthetic oligonucleotide
cagactacttcacagctggctttga

SEQ ID NO: 741861 - DNA, 25 bp, Artificial sequence
  Synthetic oligonucleotide
cagactacttcagagctggctttga

SEQ ID NO: 741862 - DNA, 25 bp, Artificial sequence
  Synthetic oligonucleotide
tagctcccagcacatcttcttttgg

SEQ ID NO: 741863 - DNA, 25 bp, Artificial sequence
  Synthetic oligonucleotide
tagctcccagcagatcttcttttgg

SEQ ID NO: 741864 - DNA, 25 bp, Artificial sequence
  Synthetic oligonucleotide
tgaaaacaaaatttatgaaaagaaa

SEQ ID NO: 741865 - DNA, 25 bp, Artificial sequence
  Synthetic oligonucleotide
tgaaaacaaaatatatgaaaagaaa

SEQ ID NO: 741866 - DNA, 25 bp, Artificial sequence
  Synthetic oligonucleotide
acaatgtataccacttgtttgaggg

SEQ ID NO: 741867 - DNA, 25 bp, Artificial sequence
  Synthetic oligonucleotide
taattattcagacgacatgaccaag

SEQ ID NO: 741868 - DNA, 25 bp, Artificial sequence
  Synthetic oligonucleotide
gaccaacaggtttcctcgatgtcga

SEQ ID NO: 741869 - DNA, 25 bp, Artificial sequence
  Synthetic oligonucleotide
ggcaaataccacatcttattgaaaa

SEQ ID NO: 741870 - DNA, 25 bp, Artificial sequence
  Synthetic oligonucleotide
acttagcaattctttgattcaaagg

SEQ ID NO: 741871 - DNA, 25 bp, Artificial sequence
  Synthetic oligonucleotide
acttagcaattcattgattcaaagg

SEQ ID NO: 741872 - DNA, 25 bp, Artificial sequence
  Synthetic oligonucleotide
aaggtaagtaaacatagttttatca

SEQ ID NO: 741873 - DNA, 25 bp, Artificial sequence
  Synthetic oligonucleotide
aaggtaagtaaagatagttttatca

SEQ ID NO: 741874 - DNA, 25 bp, Artificial sequence
  Synthetic oligonucleotide
gctacatgtaaggtatagagtaaac

SEQ ID NO: 741875 - DNA, 25 bp, Artificial sequence
  Synthetic oligonucleotide
gctacatgtaagctatagagtaaac

SEQ ID NO: 741876 - DNA, 25 bp, Artificial sequence
  Synthetic oligonucleotide
gcatgtttggagtgacaatactaat

SEQ ID NO: 741877 - DNA, 25 bp, Artificial sequence
  Synthetic oligonucleotide
gcatgtttggagagacaatactaat

SEQ ID NO: 741878 - DNA, 25 bp, Artificial sequence
  Synthetic oligonucleotide
gacttctctggctttatttcttttg

SEQ ID NO: 741879 - DNA, 25 bp, Artificial sequence
  Synthetic oligonucleotide
tattgaaatgctatcagggaaaatc

SEQ ID NO: 741880 - DNA, 25 bp, Artificial sequence
  Synthetic oligonucleotide
taattattcagaggacatgaccaag

SEQ ID NO: 741881 - DNA, 25 bp, Artificial sequence
  Synthetic oligonucleotide
tataattcaacagaaaactcatgat

SEQ ID NO: 741882 - DNA, 25 bp, Artificial sequence
  Synthetic oligonucleotide
cattgtatttaaaatcactcccaca

SEQ ID NO: 741883 - DNA, 25 bp, Artificial sequence
  Synthetic oligonucleotide
cattgtatttaatatcactcccaca

SEQ ID NO: 741884 - DNA, 25 bp, Artificial sequence
  Synthetic oligonucleotide
cgtaaaacttaaggtgcaccattct

SEQ ID NO: 741885 - DNA, 25 bp, Artificial sequence
  Synthetic oligonucleotide
cgtaaaacttaacgtgcaccattct

SEQ ID NO: 741886 - DNA, 25 bp, Artificial sequence
  Synthetic oligonucleotide
cgagaatggagcagcctacttcatt

SEQ ID NO: 741887 - DNA, 25 bp, Artificial sequence
  Synthetic oligonucleotide
cgagaatggagctgcctacttcatt

SEQ ID NO: 741888 - DNA, 25 bp, Artificial sequence
  Synthetic oligonucleotide
tctcgcatgtacctacgccaagaaa

SEQ ID NO: 741889 - DNA, 25 bp, Artificial sequence
  Synthetic oligonucleotide
tctcgcatgtacgtacgccaagaaa

SEQ ID NO: 741890 - DNA, 25 bp, Artificial sequence
  Synthetic oligonucleotide
ggcaccaaatttctatattttctct

SEQ ID NO: 741891 - DNA, 25 bp, Artificial sequence
  Synthetic oligonucleotide
ggcaccaaatttgtatattttctct

SEQ ID NO: 741892 - DNA, 25 bp, Artificial sequence
  Synthetic oligonucleotide
caatttatgcttataatcacgagta

SEQ ID NO: 741893 - DNA, 25 bp, Artificial sequence
  Synthetic oligonucleotide
acaatgtatacctcttgtttgaggg

SEQ ID NO: 741894 - DNA, 25 bp, Artificial sequence
  Synthetic oligonucleotide
tataattcaacacaaaactcatgat

SEQ ID NO: 741895 - DNA, 25 bp, Artificial sequence
  Synthetic oligonucleotide
ttatgtgtagagcaatcatttttac

SEQ ID NO: 741896 - DNA, 25 bp, Artificial sequence
  Synthetic oligonucleotide
agtgtgattctaggcttttttcatc

SEQ ID NO: 741897 - DNA, 25 bp, Artificial sequence
  Synthetic oligonucleotide
agtgtgattctacgcttttttcatc

SEQ ID NO: 741898 - DNA, 25 bp, Artificial sequence
  Synthetic oligonucleotide
ggaacattggttaaaaatacacgca

SEQ ID NO: 741899 - DNA, 25 bp, Artificial sequence
  Synthetic oligonucleotide
ggaacattggtttaaaatacacgca

SEQ ID NO: 741900 - DNA, 25 bp, Artificial sequence
  Synthetic oligonucleotide
catatttgattttatacagaagaaa

SEQ ID NO: 741901 - DNA, 25 bp, Artificial sequence
  Synthetic oligonucleotide
catatttgatttaatacagaagaaa

SEQ ID NO: 741902 - DNA, 25 bp, Artificial sequence
  Synthetic oligonucleotide
gatgattatgtgcacaagagcacta

SEQ ID NO: 741903 - DNA, 25 bp, Artificial sequence
  Synthetic oligonucleotide
gatgattatgtggacaagagcacta

SEQ ID NO: 741904 - DNA, 25 bp, Artificial sequence
  Synthetic oligonucleotide
catggcctatgttaagcaggagcgg

SEQ ID NO: 741905 - DNA, 25 bp, Artificial sequence
  Synthetic oligonucleotide
catggcctatgtaaagcaggagcgg

SEQ ID NO: 741906 - DNA, 25 bp, Artificial sequence
  Synthetic oligonucleotide
gaccaacaggttacctcgatgtcga

SEQ ID NO: 741907 - DNA, 25 bp, Artificial sequence
  Synthetic oligonucleotide
caatttatgcttttaatcacgagta

SEQ ID NO: 741908 - DNA, 25 bp, Artificial sequence
  Synthetic oligonucleotide
gggtcaaacttaaaacgtaattata

SEQ ID NO: 741909 - DNA, 25 bp, Artificial sequence
  Synthetic oligonucleotide
gacttctctggcattatttcttttg

SEQ ID NO: 741910 - DNA, 25 bp, Artificial sequence
  Synthetic oligonucleotide
caatggccgttcatgttttatgagt

SEQ ID NO: 741911 - DNA, 25 bp, Artificial sequence
  Synthetic oligonucleotide
caatggccgttcttgttttatgagt

SEQ ID NO: 741912 - DNA, 25 bp, Artificial sequence
  Synthetic oligonucleotide
catctctccaaaaatacaaaagggt

SEQ ID NO: 741913 - DNA, 25 bp, Artificial sequence
  Synthetic oligonucleotide
catctctccaaatatacaaaagggt

SEQ ID NO: 741914 - DNA, 25 bp, Artificial sequence
  Synthetic oligonucleotide
caatctaacaatgccttttgctggc

SEQ ID NO: 741915 - DNA, 25 bp, Artificial sequence
  Synthetic oligonucleotide
caatctaacaatcccttttgctggc

SEQ ID NO: 741916 - DNA, 25 bp, Artificial sequence
  Synthetic oligonucleotide
agttatgggtggactcttgtcagag

SEQ ID NO: 741917 - DNA, 25 bp, Artificial sequence
  Synthetic oligonucleotide
agttatgggtggtctcttgtcagag

SEQ ID NO: 741918 - DNA, 25 bp, Artificial sequence
  Synthetic oligonucleotide
catcgttggtctatgtgtgtagata

SEQ ID NO: 741919 - DNA, 25 bp, Artificial sequence
  Synthetic oligonucleotide
catcgttggtctttgtgtgtagata

SEQ ID NO: 741920 - DNA, 25 bp, Artificial sequence
  Synthetic oligonucleotide
tgcatgatcatcgtactttgtactg

SEQ ID NO: 741921 - DNA, 25 bp, Artificial sequence
  Synthetic oligonucleotide
ttttgatttctcactttaaaactga

SEQ ID NO: 741922 - DNA, 25 bp, Artificial sequence
  Synthetic oligonucleotide
tgagagttacataacagatggttga

SEQ ID NO: 741923 - DNA, 25 bp, Artificial sequence
  Synthetic oligonucleotide
gggtcaaacttataacgtaattata

SEQ ID NO: 741924 - DNA, 25 bp, Artificial sequence
  Synthetic oligonucleotide
tcaacagagaatcgctcagctttgc

SEQ ID NO: 741925 - DNA, 25 bp, Artificial sequence
  Synthetic oligonucleotide
tcaacagagaatggctcagctttgc

SEQ ID NO: 741926 - DNA, 25 bp, Artificial sequence
  Synthetic oligonucleotide
ttccaggtgcaagactccatcgtag

SEQ ID NO: 741927 - DNA, 25 bp, Artificial sequence
  Synthetic oligonucleotide
ttccaggtgcaacactccatcgtag

SEQ ID NO: 741928 - DNA, 25 bp, Artificial sequence
  Synthetic oligonucleotide
ttttttttgtaaatctctaactctc

SEQ ID NO: 741929 - DNA, 25 bp, Artificial sequence
  Synthetic oligonucleotide
ttttttttgtaattctctaactctc

SEQ ID NO: 741930 - DNA, 25 bp, Artificial sequence
  Synthetic oligonucleotide
tgtcagcccgatgtccgaacattat

SEQ ID NO: 741931 - DNA, 25 bp, Artificial sequence
  Synthetic oligonucleotide
tgtcagcccgatctccgaacattat

SEQ ID NO: 741932 - DNA, 25 bp, Artificial sequence
  Synthetic oligonucleotide
agaatggaatccctgtcgttagcaa

SEQ ID NO: 741933 - DNA, 25 bp, Artificial sequence
  Synthetic oligonucleotide
agaatggaatccgtgtcgttagcaa

SEQ ID NO: 741934 - DNA, 25 bp, Artificial sequence
  Synthetic oligonucleotide
ttttgatttctctctttaaaactga

SEQ ID NO: 741935 - DNA, 25 bp, Artificial sequence
  Synthetic oligonucleotide
tatcatctcagcaaggagttggtgg

SEQ ID NO: 741936 - DNA, 25 bp, Artificial sequence
  Synthetic oligonucleotide
tgtatacaatatgatcaactcatgt

SEQ ID NO: 741937 - DNA, 25 bp, Artificial sequence
  Synthetic oligonucleotide
tgtatacaatatcatcaactcatgt

SEQ ID NO: 741938 - DNA, 25 bp, Artificial sequence
  Synthetic oligonucleotide
ccgacgtatatgttgtgtagctatg

SEQ ID NO: 741939 - DNA, 25 bp, Artificial sequence
  Synthetic oligonucleotide
ccgacgtatatgatgtgtagctatg

SEQ ID NO: 741940 - DNA, 25 bp, Artificial sequence
  Synthetic oligonucleotide
tctccaagtgattggtgactgcgga

SEQ ID NO: 741941 - DNA, 25 bp, Artificial sequence
  Synthetic oligonucleotide
tctccaagtgataggtgactgcgga

SEQ ID NO: 741942 - DNA, 25 bp, Artificial sequence
  Synthetic oligonucleotide
taatagcatacaagaggttaccaag

SEQ ID NO: 741943 - DNA, 25 bp, Artificial sequence
  Synthetic oligonucleotide
taatagcatacatgaggttaccaag

SEQ ID NO: 741944 - DNA, 25 bp, Artificial sequence
  Synthetic oligonucleotide
gctatattctcattggtattggatg

SEQ ID NO: 741945 - DNA, 25 bp, Artificial sequence
  Synthetic oligonucleotide
gctatattctcaatggtattggatg

SEQ ID NO: 741946 - DNA, 25 bp, Artificial sequence
  Synthetic oligonucleotide
tgagactcgggttagcggaacacat

SEQ ID NO: 741947 - DNA, 25 bp, Artificial sequence
  Synthetic oligonucleotide
tgcatgatcatcctactttgtactg

SEQ ID NO: 741948 - DNA, 25 bp, Artificial sequence
  Synthetic oligonucleotide
tatcatctcagctaggagttggtgg

SEQ ID NO: 741949 - DNA, 25 bp, Artificial sequence
  Synthetic oligonucleotide
gaacctagccactacactatcatcg

SEQ ID NO: 741950 - DNA, 25 bp, Artificial sequence
  Synthetic oligonucleotide
ccaatctggtttatgatttgtcgga

SEQ ID NO: 741951 - DNA, 25 bp, Artificial sequence
  Synthetic oligonucleotide
ccaatctggtttttgatttgtcgga

SEQ ID NO: 741952 - DNA, 25 bp, Artificial sequence
  Synthetic oligonucleotide
ggtatttgttctacctcacattact

SEQ ID NO: 741953 - DNA, 25 bp, Artificial sequence
  Synthetic oligonucleotide
ggtatttgttcttcctcacattact

SEQ ID NO: 741954 - DNA, 25 bp, Artificial sequence
  Synthetic oligonucleotide
caacagtggctgtgagatatgtact

SEQ ID NO: 741955 - DNA, 25 bp, Artificial sequence
  Synthetic oligonucleotide
caacagtggctgagagatatgtact

SEQ ID NO: 741956 - DNA, 25 bp, Artificial sequence
  Synthetic oligonucleotide
tgaagaccatatgcacaaaacatgg

SEQ ID NO: 741957 - DNA, 25 bp, Artificial sequence
  Synthetic oligonucleotide
tgaagaccatatccacaaaacatgg

SEQ ID NO: 741958 - DNA, 25 bp, Artificial sequence
  Synthetic oligonucleotide
gggtggaatctatttcaaggtttac

SEQ ID NO: 741959 - DNA, 25 bp, Artificial sequence
  Synthetic oligonucleotide
gggtggaatctaattcaaggtttac

SEQ ID NO: 741960 - DNA, 25 bp, Artificial sequence
  Synthetic oligonucleotide
tgagagttacattacagatggttga

SEQ ID NO: 741961 - DNA, 25 bp, Artificial sequence
  Synthetic oligonucleotide
tgagactcgggtaagcggaacacat

SEQ ID NO: 741962 - DNA, 25 bp, Artificial sequence
  Synthetic oligonucleotide
gtttctcgccgtagaactatctcca

SEQ ID NO: 741963 - DNA, 25 bp, Artificial sequence
  Synthetic oligonucleotide
tggaaacgtatggaatgactaaaca

SEQ ID NO: 741964 - DNA, 25 bp, Artificial sequence
  Synthetic oligonucleotide
tggaaacgtatgcaatgactaaaca

SEQ ID NO: 741965 - DNA, 25 bp, Artificial sequence
  Synthetic oligonucleotide
agtagaaacactagaaccctaattc

SEQ ID NO: 741966 - DNA, 25 bp, Artificial sequence
  Synthetic oligonucleotide
agtagaaacacttgaaccctaattc

SEQ ID NO: 741967 - DNA, 25 bp, Artificial sequence
  Synthetic oligonucleotide
cataaatctttctatttgagtggaa

SEQ ID NO: 741968 - DNA, 25 bp, Artificial sequence
  Synthetic oligonucleotide
cataaatctttcaatttgagtggaa

SEQ ID NO: 741969 - DNA, 25 bp, Artificial sequence
  Synthetic oligonucleotide
cttgattcccctaacttgaaagtaa

SEQ ID NO: 741970 - DNA, 25 bp, Artificial sequence
  Synthetic oligonucleotide
gaatgtaagaattaaaaaaagcgta

SEQ ID NO: 741971 - DNA, 25 bp, Artificial sequence
  Synthetic oligonucleotide
tatcacgactaatacatgctagttg

SEQ ID NO: 741972 - DNA, 25 bp, Artificial sequence
  Synthetic oligonucleotide
tttgagaggatgttgagaggacaga

SEQ ID NO: 741973 - DNA, 25 bp, Artificial sequence
  Synthetic oligonucleotide
ccttcataaaaaatgaaacatatta

SEQ ID NO: 741974 - DNA, 25 bp, Artificial sequence
  Synthetic oligonucleotide
cactaaaggatctagaaccagaaac

SEQ ID NO: 741975 - DNA, 25 bp, Artificial sequence
  Synthetic oligonucleotide
ccttcataaaaattgaaacatatta

SEQ ID NO: 741976 - DNA, 25 bp, Artificial sequence
  Synthetic oligonucleotide
aaaaacattttatttgagttgtcgc

SEQ ID NO: 741977 - DNA, 25 bp, Artificial sequence
  Synthetic oligonucleotide
aaaaacattttaattgagttgtcgc

SEQ ID NO: 741978 - DNA, 25 bp, Artificial sequence
  Synthetic oligonucleotide
cgatgtaccctaaatatagttccaa

SEQ ID NO: 741979 - DNA, 25 bp, Artificial sequence
  Synthetic oligonucleotide
cgatgtaccctatatatagttccaa

SEQ ID NO: 741980 - DNA, 25 bp, Artificial sequence
  Synthetic oligonucleotide
tatcccatcaactacaactattatg

SEQ ID NO: 741981 - DNA, 25 bp, Artificial sequence
  Synthetic oligonucleotide
tatcccatcaacaacaactattatg

SEQ ID NO: 741982 - DNA, 25 bp, Artificial sequence
  Synthetic oligonucleotide
agtaaaagaaacaaatcttatctgg

SEQ ID NO: 741983 - DNA, 25 bp, Artificial sequence
  Synthetic oligonucleotide
agtaaaagaaactaatcttatctgg

SEQ ID NO: 741984 - DNA, 25 bp, Artificial sequence
  Synthetic oligonucleotide
tgcacacagacctatggacgtagag

SEQ ID NO: 741985 - DNA, 25 bp, Artificial sequence
  Synthetic oligonucleotide
tatcacgactaaaacatgctagttg

SEQ ID NO: 741986 - DNA, 25 bp, Artificial sequence
  Synthetic oligonucleotide
tgatgttcaactagtattgttttgg

SEQ ID NO: 741987 - DNA, 25 bp, Artificial sequence
  Synthetic oligonucleotide
tttgagaggatgatgagaggacaga

SEQ ID NO: 741988 - DNA, 25 bp, Artificial sequence
  Synthetic oligonucleotide
tcagatggcgaatttgacaatggag

SEQ ID NO: 741989 - DNA, 25 bp, Artificial sequence
  Synthetic oligonucleotide
tcagatggcgaaattgacaatggag

SEQ ID NO: 741990 - DNA, 25 bp, Artificial sequence
  Synthetic oligonucleotide
atgggtgctttacccgttgggccaa

SEQ ID NO: 741991 - DNA, 25 bp, Artificial sequence
  Synthetic oligonucleotide
atgggtgctttagccgttgggccaa

SEQ ID NO: 741992 - DNA, 25 bp, Artificial sequence
  Synthetic oligonucleotide
catgcaataggtagtgtctatcacc

SEQ ID NO: 741993 - DNA, 25 bp, Artificial sequence
  Synthetic oligonucleotide
catgcaataggttgtgtctatcacc

SEQ ID NO: 741994 - DNA, 25 bp, Artificial sequence
  Synthetic oligonucleotide
tacgtgcttcctataactgagaact

SEQ ID NO: 741995 - DNA, 25 bp, Artificial sequence
  Synthetic oligonucleotide
tacgtgcttcctttaactgagaact

SEQ ID NO: 741996 - DNA, 25 bp, Artificial sequence
  Synthetic oligonucleotide
tagttgaggccaataaaacttagct

SEQ ID NO: 741997 - DNA, 25 bp, Artificial sequence
  Synthetic oligonucleotide
ccaaaattcaggataatcattatag

SEQ ID NO: 741998 - DNA, 25 bp, Artificial sequence
  Synthetic oligonucleotide
tgatgttcaacttgtattgttttgg

SEQ ID NO: 741999 - DNA, 25 bp, Artificial sequence
  Synthetic oligonucleotide
ccaaaattcaggttaatcattatag

SEQ ID NO: 742000 - DNA, 25 bp, Artificial sequence
  Synthetic oligonucleotide
ttggaccatataagtaaaacagagc

SEQ ID NO: 742001 - DNA, 25 bp, Artificial sequence
  Synthetic oligonucleotide
ttggaccatatatgtaaaacagagc

SEQ ID NO: 742002 - DNA, 25 bp, Artificial sequence
  Synthetic oligonucleotide
gtttgatgtgatcattgcatcgtgc

SEQ ID NO: 742003 - DNA, 25 bp, Artificial sequence
  Synthetic oligonucleotide
gtttgatgtgatgattgcatcgtgc

SEQ ID NO: 742004 - DNA, 25 bp, Artificial sequence
  Synthetic oligonucleotide
atttggggatcactcgtctattagc

SEQ ID NO: 742005 - DNA, 25 bp, Artificial sequence
  Synthetic oligonucleotide
atttggggatcagtcgtctattagc

SEQ ID NO: 742006 - DNA, 25 bp, Artificial sequence
  Synthetic oligonucleotide
aatatcattatattgcttcttcttc

SEQ ID NO: 742007 - DNA, 25 bp, Artificial sequence
  Synthetic oligonucleotide
aatatcattataatgcttcttcttc

SEQ ID NO: 742008 - DNA, 25 bp, Artificial sequence
  Synthetic oligonucleotide
cactaaaggatcaagaaccagaaac

SEQ ID NO: 742009 - DNA, 25 bp, Artificial sequence
  Synthetic oligonucleotide
cgagccagatgtgaggtaccttgag

SEQ ID NO: 742010 - DNA, 25 bp, Artificial sequence
  Synthetic oligonucleotide
tagttgaggccattaaaacttagct

SEQ ID NO: 742011 - DNA, 25 bp, Artificial sequence
  Synthetic oligonucleotide
cacaaaaagtttaaataatgttgtc

SEQ ID NO: 742012 - DNA, 25 bp, Artificial sequence
  Synthetic oligonucleotide
tactagtatattataattgaaaaga

SEQ ID NO: 742013 - DNA, 25 bp, Artificial sequence
  Synthetic oligonucleotide
tactagtatattttaattgaaaaga

SEQ ID NO: 742014 - DNA, 25 bp, Artificial sequence
  Synthetic oligonucleotide
tatgttttctgcaatctcggagaga

SEQ ID NO: 742015 - DNA, 25 bp, Artificial sequence
  Synthetic oligonucleotide
tatgttttctgctatctcggagaga

SEQ ID NO: 742016 - DNA, 25 bp, Artificial sequence
  Synthetic oligonucleotide
ttaggtaaacgatatttaagatgct

SEQ ID NO: 742017 - DNA, 25 bp, Artificial sequence
  Synthetic oligonucleotide
ttaggtaaacgaaatttaagatgct

SEQ ID NO: 742018 - DNA, 25 bp, Artificial sequence
  Synthetic oligonucleotide
aaaactgcaaaatgtattattcgta

SEQ ID NO: 742019 - DNA, 25 bp, Artificial sequence
  Synthetic oligonucleotide
aaaactgcaaaaagtattattcgta

SEQ ID NO: 742020 - DNA, 25 bp, Artificial sequence
  Synthetic oligonucleotide
taggtaaatgaaactctaataaatt

SEQ ID NO: 742021 - DNA, 25 bp, Artificial sequence
  Synthetic oligonucleotide
tgcacacagaccaatggacgtagag

SEQ ID NO: 742022 - DNA, 25 bp, Artificial sequence
  Synthetic oligonucleotide
cacaaaaagttttaataatgttgtc

SEQ ID NO: 742023 - DNA, 25 bp, Artificial sequence
  Synthetic oligonucleotide
ctgtgtatttaatattttgtttaga

SEQ ID NO: 742024 - DNA, 25 bp, Artificial sequence
  Synthetic oligonucleotide
ttaacaatcgaatcaaaacaaaatg

SEQ ID NO: 742025 - DNA, 25 bp, Artificial sequence
  Synthetic oligonucleotide
ttaacaatcgaaacaaaacaaaatg

SEQ ID NO: 742026 - DNA, 25 bp, Artificial sequence
  Synthetic oligonucleotide
aaaagatttggtccggtcggagaga

SEQ ID NO: 742027 - DNA, 25 bp, Artificial sequence
  Synthetic oligonucleotide
aaaagatttggtgcggtcggagaga

SEQ ID NO: 742028 - DNA, 25 bp, Artificial sequence
  Synthetic oligonucleotide
gaaagtcatcgtgactcccagaaag

SEQ ID NO: 742029 - DNA, 25 bp, Artificial sequence
  Synthetic oligonucleotide
gaaagtcatcgtcactcccagaaag

SEQ ID NO: 742030 - DNA, 25 bp, Artificial sequence
  Synthetic oligonucleotide
caaaggtatgagaagactatccgac

SEQ ID NO: 742031 - DNA, 25 bp, Artificial sequence
  Synthetic oligonucleotide
caaaggtatgagtagactatccgac

SEQ ID NO: 742032 - DNA, 25 bp, Artificial sequence
  Synthetic oligonucleotide
tctggatacgaaatgtttctccact

SEQ ID NO: 742033 - DNA, 25 bp, Artificial sequence
  Synthetic oligonucleotide
tctggatacgaattgtttctccact

SEQ ID NO: 742034 - DNA, 25 bp, Artificial sequence
  Synthetic oligonucleotide
taggtaaatgaatctctaataaatt

SEQ ID NO: 742035 - DNA, 25 bp, Artificial sequence
  Synthetic oligonucleotide
tttaataaaatctccgccgtctgaa

SEQ ID NO: 742036 - DNA, 25 bp, Artificial sequence
  Synthetic oligonucleotide
cttgattccccttacttgaaagtaa

SEQ ID NO: 742037 - DNA, 25 bp, Artificial sequence
  Synthetic oligonucleotide
gtcacattgaggtatctttggcggg

SEQ ID NO: 742038 - DNA, 25 bp, Artificial sequence
  Synthetic oligonucleotide
gtcacattgaggaatctttggcggg

SEQ ID NO: 742039 - DNA, 25 bp, Artificial sequence
  Synthetic oligonucleotide
tacctataaaaatggcggccgcaaa

SEQ ID NO: 742040 - DNA, 25 bp, Artificial sequence
  Synthetic oligonucleotide
tacctataaaaaaggcggccgcaaa

SEQ ID NO: 742041 - DNA, 25 bp, Artificial sequence
  Synthetic oligonucleotide
ctccgatgtttctatcgtgaaatcg

SEQ ID NO: 742042 - DNA, 25 bp, Artificial sequence
  Synthetic oligonucleotide
ctccgatgtttcaatcgtgaaatcg

SEQ ID NO: 742043 - DNA, 25 bp, Artificial sequence
  Synthetic oligonucleotide
taaaaaaagaaataagaggaggcga

SEQ ID NO: 742044 - DNA, 25 bp, Artificial sequence
  Synthetic oligonucleotide
taaaaaaagaaaaaagaggaggcga

SEQ ID NO: 742045 - DNA, 25 bp, Artificial sequence
  Synthetic oligonucleotide
acctgacggcgacgaccggtgattc

SEQ ID NO: 742046 - DNA, 25 bp, Artificial sequence
  Synthetic oligonucleotide
aacttattggtaaataagttatatc

SEQ ID NO: 742047 - DNA, 25 bp, Artificial sequence
  Synthetic oligonucleotide
tttaataaaatcaccgccgtctgaa

SEQ ID NO: 742048 - DNA, 25 bp, Artificial sequence
  Synthetic oligonucleotide
aacttattggtatataagttatatc

SEQ ID NO: 742049 - DNA, 25 bp, Artificial sequence
  Synthetic oligonucleotide
ctcaaatttgtgttactgtaatggc

SEQ ID NO: 742050 - DNA, 25 bp, Artificial sequence
  Synthetic oligonucleotide
ctcaaatttgtgatactgtaatggc

SEQ ID NO: 742051 - DNA, 25 bp, Artificial sequence
  Synthetic oligonucleotide
tgtttagagatcaatatttggagaa

SEQ ID NO: 742052 - DNA, 25 bp, Artificial sequence
  Synthetic oligonucleotide
tgtttagagatctatatttggagaa

SEQ ID NO: 742053 - DNA, 25 bp, Artificial sequence
  Synthetic oligonucleotide
tttttgttaagaatacggattgtat

SEQ ID NO: 742054 - DNA, 25 bp, Artificial sequence
  Synthetic oligonucleotide
tttttgttaagattacggattgtat

SEQ ID NO: 742055 - DNA, 25 bp, Artificial sequence
  Synthetic oligonucleotide
tttataatttgttgtatggattaca

SEQ ID NO: 742056 - DNA, 25 bp, Artificial sequence
  Synthetic oligonucleotide
tttataatttgtagtatggattaca

SEQ ID NO: 742057 - DNA, 25 bp, Artificial sequence
  Synthetic oligonucleotide
ctgtgtatttaaaattttgtttaga

SEQ ID NO: 742058 - DNA, 25 bp, Artificial sequence
  Synthetic oligonucleotide
cgagccagatgtcaggtaccttgag

SEQ ID NO: 742059 - DNA, 25 bp, Artificial sequence
  Synthetic oligonucleotide
acctgacggcgaggaccggtgattc

SEQ ID NO: 742060 - DNA, 25 bp, Artificial sequence
  Synthetic oligonucleotide
cacaagctgagtaaagagacgctct

SEQ ID NO: 742061 - DNA, 25 bp, Artificial sequence
  Synthetic oligonucleotide
gcagaagcctacatcttcccagtca

SEQ ID NO: 742062 - DNA, 25 bp, Artificial sequence
  Synthetic oligonucleotide
agcagaaaatcttcattgtcttgcc

SEQ ID NO: 742063 - DNA, 25 bp, Artificial sequence
  Synthetic oligonucleotide
agcagaaaatctacattgtcttgcc

SEQ ID NO: 742064 - DNA, 25 bp, Artificial sequence
  Synthetic oligonucleotide
caacaacagcatttcactttggaga

SEQ ID NO: 742065 - DNA, 25 bp, Artificial sequence
  Synthetic oligonucleotide
caacaacagcatatcactttggaga

SEQ ID NO: 742066 - DNA, 25 bp, Artificial sequence
  Synthetic oligonucleotide
tctcctcaattagaagctgggttta

SEQ ID NO: 742067 - DNA, 25 bp, Artificial sequence
  Synthetic oligonucleotide
tctcctcaattacaagctgggttta

SEQ ID NO: 742068 - DNA, 25 bp, Artificial sequence
  Synthetic oligonucleotide
gaggttacgcaagatagtacctttg

SEQ ID NO: 742069 - DNA, 25 bp, Artificial sequence
  Synthetic oligonucleotide
gaggttacgcaacatagtacctttg

SEQ ID NO: 742070 - DNA, 25 bp, Artificial sequence
  Synthetic oligonucleotide
ggtgccttctcttcctctgcctgaa

SEQ ID NO: 742071 - DNA, 25 bp, Artificial sequence
  Synthetic oligonucleotide
ttttgatggagaagaagacgcttgg

SEQ ID NO: 742072 - DNA, 25 bp, Artificial sequence
  Synthetic oligonucleotide
cacaagctgagttaagagacgctct

SEQ ID NO: 742073 - DNA, 25 bp, Artificial sequence
  Synthetic oligonucleotide
gaactgagcaagactgttccttcca

SEQ ID NO: 742074 - DNA, 25 bp, Artificial sequence
  Synthetic oligonucleotide
taccactcctgtacccactgtggtg

SEQ ID NO: 742075 - DNA, 25 bp, Artificial sequence
  Synthetic oligonucleotide
taccactcctgttcccactgtggtg

SEQ ID NO: 742076 - DNA, 25 bp, Artificial sequence
  Synthetic oligonucleotide
tcctctacctgaacaattcattttg

SEQ ID NO: 742077 - DNA, 25 bp, Artificial sequence
  Synthetic oligonucleotide
tcctctacctgatcaattcattttg

SEQ ID NO: 742078 - DNA, 25 bp, Artificial sequence
  Synthetic oligonucleotide
tctcattcgcaagttcagttcagag

SEQ ID NO: 742079 - DNA, 25 bp, Artificial sequence
  Synthetic oligonucleotide
tctcattcgcaacttcagttcagag

SEQ ID NO: 742080 - DNA, 25 bp, Artificial sequence
  Synthetic oligonucleotide
tgcgaatacgcataaaactactcct

SEQ ID NO: 742081 - DNA, 25 bp, Artificial sequence
  Synthetic oligonucleotide
tgcgaatacgcaaaaaactactcct

SEQ ID NO: 742082 - DNA, 25 bp, Artificial sequence
  Synthetic oligonucleotide
ggtgcattctcttccggtaactgaa

SEQ ID NO: 742083 - DNA, 25 bp, Artificial sequence
  Synthetic oligonucleotide
ggtgcattctctaccggtaactgaa

SEQ ID NO: 742084 - DNA, 25 bp, Artificial sequence
  Synthetic oligonucleotide
ggtgccttctctacctctgcctgaa

SEQ ID NO: 742085 - DNA, 25 bp, Artificial sequence
  Synthetic oligonucleotide
gaacatgtttttgttcttcttgtga

SEQ ID NO: 742086 - DNA, 25 bp, Artificial sequence
  Synthetic oligonucleotide
tctccgtctgcttagaaaataaaac

SEQ ID NO: 742087 - DNA, 25 bp, Artificial sequence
  Synthetic oligonucleotide
tctccgtctgctaagaaaataaaac

SEQ ID NO: 742088 - DNA, 25 bp, Artificial sequence
  Synthetic oligonucleotide
tagggtttgatcgtctctctttcaa

SEQ ID NO: 742089 - DNA, 25 bp, Artificial sequence
  Synthetic oligonucleotide
tagggtttgatcctctctctttcaa

SEQ ID NO: 742090 - DNA, 25 bp, Artificial sequence
  Synthetic oligonucleotide
tactggtagtttggattgtaatatc

SEQ ID NO: 742091 - DNA, 25 bp, Artificial sequence
  Synthetic oligonucleotide
tactggtagtttcgattgtaatatc

SEQ ID NO: 742092 - DNA, 25 bp, Artificial sequence
  Synthetic oligonucleotide
ccgcggattatagtaagattacaag

SEQ ID NO: 742093 - DNA, 25 bp, Artificial sequence
  Synthetic oligonucleotide
ccgcggattatactaagattacaag

SEQ ID NO: 742094 - DNA, 25 bp, Artificial sequence
  Synthetic oligonucleotide
gattcattcactccaaatttccttc

SEQ ID NO: 742095 - DNA, 25 bp, Artificial sequence
  Synthetic oligonucleotide
gattcattcactgcaaatttccttc

SEQ ID NO: 742096 - DNA, 25 bp, Artificial sequence
  Synthetic oligonucleotide
ttttgatggagatgaagacgcttgg

SEQ ID NO: 742097 - DNA, 25 bp, Artificial sequence
  Synthetic oligonucleotide
cttggaaacttctgataacaaatcg

SEQ ID NO: 742098 - DNA, 25 bp, Artificial sequence
  Synthetic oligonucleotide
ccttgtgatttttgaataaattgtg

SEQ ID NO: 742099 - DNA, 25 bp, Artificial sequence
  Synthetic oligonucleotide
gaacatgtttttcttcttcttgtga

SEQ ID NO: 742100 - DNA, 25 bp, Artificial sequence
  Synthetic oligonucleotide
gaatgtaagaataaaaaaaagcgta

SEQ ID NO: 742101 - DNA, 25 bp, Artificial sequence
  Synthetic oligonucleotide
agcatacttctcgaattctctttgg

SEQ ID NO: 742102 - DNA, 25 bp, Artificial sequence
  Synthetic oligonucleotide
gaacgaatgggtaggatctatagga

SEQ ID NO: 742103 - DNA, 25 bp, Artificial sequence
  Synthetic oligonucleotide
ccttgtgattttagaataaattgtg

SEQ ID NO: 742104 - DNA, 25 bp, Artificial sequence
  Synthetic oligonucleotide
tggtttcctttttgcttgatgttgt

SEQ ID NO: 742105 - DNA, 25 bp, Artificial sequence
  Synthetic oligonucleotide
tggtttccttttagcttgatgttgt

SEQ ID NO: 742106 - DNA, 25 bp, Artificial sequence
  Synthetic oligonucleotide
tcaggttacaatcgcgaagctaagg

SEQ ID NO: 742107 - DNA, 25 bp, Artificial sequence
  Synthetic oligonucleotide
tcaggttacaatggcgaagctaagg

SEQ ID NO: 742108 - DNA, 25 bp, Artificial sequence
  Synthetic oligonucleotide
gaactgagcaagtctgttccttcca

SEQ ID NO: 742109 - DNA, 25 bp, Artificial sequence
  Synthetic oligonucleotide
cttggaaacttcagataacaaatcg

SEQ ID NO: 742110 - DNA, 25 bp, Artificial sequence
  Synthetic oligonucleotide
ggaaagctccagcaccaaagagatc

SEQ ID NO: 742111 - DNA, 25 bp, Artificial sequence
  Synthetic oligonucleotide
cacaagctgaggaaagaacgttgac

SEQ ID NO: 742112 - DNA, 25 bp, Artificial sequence
  Synthetic oligonucleotide
cacaagctgaggtaagaacgttgac

SEQ ID NO: 742113 - DNA, 25 bp, Artificial sequence
  Synthetic oligonucleotide
tacccatgttcacacagcgatgcct

SEQ ID NO: 742114 - DNA, 25 bp, Artificial sequence
  Synthetic oligonucleotide
tacccatgttcagacagcgatgcct

SEQ ID NO: 742115 - DNA, 25 bp, Artificial sequence
  Synthetic oligonucleotide
gaacattgcactttgcagaagcctg

SEQ ID NO: 742116 - DNA, 25 bp, Artificial sequence
  Synthetic oligonucleotide
gaacattgcactatgcagaagcctg

SEQ ID NO: 742117 - DNA, 25 bp, Artificial sequence
  Synthetic oligonucleotide
tcgcaagctgaaactagtcgtgttc

SEQ ID NO: 742118 - DNA, 25 bp, Artificial sequence
  Synthetic oligonucleotide
tcgcaagctgaatctagtcgtgttc

SEQ ID NO: 742119 - DNA, 25 bp, Artificial sequence
  Synthetic oligonucleotide
gaacctgaggccagtcctgatttca

SEQ ID NO: 742120 - DNA, 25 bp, Artificial sequence
  Synthetic oligonucleotide
gaacctgaggcctgtcctgatttca

SEQ ID NO: 742121 - DNA, 25 bp, Artificial sequence
  Synthetic oligonucleotide
tgaacattacagactactcaagcct

SEQ ID NO: 742122 - DNA, 25 bp, Artificial sequence
  Synthetic oligonucleotide
aaaccggagatagttatgagtcgca

SEQ ID NO: 742123 - DNA, 25 bp, Artificial sequence
  Synthetic oligonucleotide
ggaaagctccaggaccaaagagatc

SEQ ID NO: 742124 - DNA, 25 bp, Artificial sequence
  Synthetic oligonucleotide
taggaagaatcacgatagaagagtg

SEQ ID NO: 742125 - DNA, 25 bp, Artificial sequence
  Synthetic oligonucleotide
cgtgcgggtcacaagcccataaggt

SEQ ID NO: 742126 - DNA, 25 bp, Artificial sequence
  Synthetic oligonucleotide
cgtgcgggtcactagcccataaggt

SEQ ID NO: 742127 - DNA, 25 bp, Artificial sequence
  Synthetic oligonucleotide
tgtgtagctctgatgttatggataa

SEQ ID NO: 742128 - DNA, 25 bp, Artificial sequence
  Synthetic oligonucleotide
tgtgtagctctgttgttatggataa

SEQ ID NO: 742129 - DNA, 25 bp, Artificial sequence
  Synthetic oligonucleotide
tgttgaatctggtgaagaaggttga

SEQ ID NO: 742130 - DNA, 25 bp, Artificial sequence
  Synthetic oligonucleotide
tgttgaatctggagaagaaggttga

SEQ ID NO: 742131 - DNA, 25 bp, Artificial sequence
  Synthetic oligonucleotide
gaacgaatgggttggatctatagga

SEQ ID NO: 742132 - DNA, 25 bp, Artificial sequence
  Synthetic oligonucleotide
gcagaagcctacttcttcccagtca

SEQ ID NO: 742133 - DNA, 25 bp, Artificial sequence
  Synthetic oligonucleotide
agcatacttctccaattctctttgg

SEQ ID NO: 742134 - DNA, 25 bp, Artificial sequence
  Synthetic oligonucleotide
aaaccggagatacttatgagtcgca

SEQ ID NO: 742135 - DNA, 25 bp, Artificial sequence
  Synthetic oligonucleotide
tcacaagcggattcacacgaaacta

SEQ ID NO: 742136 - DNA, 25 bp, Artificial sequence
  Synthetic oligonucleotide
taagagagtctattgcggatactca

SEQ ID NO: 742137 - DNA, 25 bp, Artificial sequence
  Synthetic oligonucleotide
taagagagtctaatgcggatactca

SEQ ID NO: 742138 - DNA, 25 bp, Artificial sequence
  Synthetic oligonucleotide
taggaagaatcaggatagaagagtg

SEQ ID NO: 742139 - DNA, 25 bp, Artificial sequence
  Synthetic oligonucleotide
tgaacattacagtctactcaagcct

SEQ ID NO: 742140 - DNA, 25 bp, Artificial sequence
  Synthetic oligonucleotide
cctcttcaaacagagatttcttctc

SEQ ID NO: 742141 - DNA, 25 bp, Artificial sequence
  Synthetic oligonucleotide
cctcttcaaacacagatttcttctc

SEQ ID NO: 742142 - DNA, 25 bp, Artificial sequence
  Synthetic oligonucleotide
caacacttcgttttgcagaagcccg

SEQ ID NO: 742143 - DNA, 25 bp, Artificial sequence
  Synthetic oligonucleotide
tcacaagcggatacacacgaaacta

SEQ ID NO: 742144 - DNA, 25 bp, Artificial sequence
  Synthetic oligonucleotide
tactgccttctcatcctgtacctga

SEQ ID NO: 742145 - DNA, 25 bp, Artificial sequence
  Synthetic oligonucleotide
tactgccttctcttcctgtacctga

SEQ ID NO: 742146 - DNA, 25 bp, Artificial sequence
  Synthetic oligonucleotide
gcagaagcctgcaacttctcaatca

SEQ ID NO: 742147 - DNA, 25 bp, Artificial sequence
  Synthetic oligonucleotide
gcagaagcctgctacttctcaatca

SEQ ID NO: 742148 - DNA, 25 bp, Artificial sequence
  Synthetic oligonucleotide
agcagcgatgccttctcttcctgta

SEQ ID NO: 742149 - DNA, 25 bp, Artificial sequence
  Synthetic oligonucleotide
caacacttcgttatgcagaagcccg

SEQ ID NO: 742150 - DNA, 25 bp, Artificial sequence
  Synthetic oligonucleotide
taagagcgaatacgcgcaaagctac

SEQ ID NO: 742151 - DNA, 25 bp, Artificial sequence
  Synthetic oligonucleotide
tgttcacgcagctgcgataccttct

SEQ ID NO: 742152 - DNA, 25 bp, Artificial sequence
  Synthetic oligonucleotide
ttacagtctacagaagccttcaact

SEQ ID NO: 742153 - DNA, 25 bp, Artificial sequence
  Synthetic oligonucleotide
gctgagttaagagcgaagacgcgca

SEQ ID NO: 742154 - DNA, 25 bp, Artificial sequence
  Synthetic oligonucleotide
ttacagtctacacaagccttcaact

SEQ ID NO: 742155 - DNA, 25 bp, Artificial sequence
  Synthetic oligonucleotide
gctgagttaagaccgaagacgcgca

SEQ ID NO: 742156 - DNA, 25 bp, Artificial sequence
  Synthetic oligonucleotide
agcagcgatgccatctcttcctgta

SEQ ID NO: 742157 - DNA, 25 bp, Artificial sequence
  Synthetic oligonucleotide
tgttcacgcagcagcgataccttct

SEQ ID NO: 742158 - DNA, 25 bp, Artificial sequence
  Synthetic oligonucleotide
taagagcgaataggcgcaaagctac

SEQ ID NO: 742159 - DNA, 25 bp, Artificial sequence
  Synthetic oligonucleotide
taatagtttcgaagatttaaagttc

SEQ ID NO: 742160 - DNA, 25 bp, Artificial sequence
  Synthetic oligonucleotide
taatagtttcgatgatttaaagttc

SEQ ID NO: 742161 - DNA, 25 bp, Artificial sequence
  Synthetic oligonucleotide
aagtcttatgcatggataatctctt

SEQ ID NO: 742162 - DNA, 25 bp, Artificial sequence
  Synthetic oligonucleotide
tattttcacatagctgtcttcacca

SEQ ID NO: 742163 - DNA, 25 bp, Artificial sequence
  Synthetic oligonucleotide
aagtcttatgcaaggataatctctt

SEQ ID NO: 742164 - DNA, 25 bp, Artificial sequence
  Synthetic oligonucleotide
tatggaaaatgacagctcttgagcc

SEQ ID NO: 742165 - DNA, 25 bp, Artificial sequence
  Synthetic oligonucleotide
tattttcacatacctgtcttcacca

SEQ ID NO: 742166 - DNA, 25 bp, Artificial sequence
  Synthetic oligonucleotide
tatggaaaatgagagctcttgagcc

SEQ ID NO: 742167 - DNA, 25 bp, Artificial sequence
  Synthetic oligonucleotide
gcgatttataattgtgggttgagaa

SEQ ID NO: 742168 - DNA, 25 bp, Artificial sequence
  Synthetic oligonucleotide
tcttgtgaaagatattatttgtttg

SEQ ID NO: 742169 - DNA, 25 bp, Artificial sequence
  Synthetic oligonucleotide
caaatgtgcataaacctctgagcgt

SEQ ID NO: 742170 - DNA, 25 bp, Artificial sequence
  Synthetic oligonucleotide
tgaaagaagagctagcgacgtggcc

SEQ ID NO: 742171 - DNA, 25 bp, Artificial sequence
  Synthetic oligonucleotide
catatataactttgctatccttaag

SEQ ID NO: 742172 - DNA, 25 bp, Artificial sequence
  Synthetic oligonucleotide
tcttgtgaaagaaattatttgtttg

SEQ ID NO: 742173 - DNA, 25 bp, Artificial sequence
  Synthetic oligonucleotide
catatttctattaagcggtattaac

SEQ ID NO: 742174 - DNA, 25 bp, Artificial sequence
  Synthetic oligonucleotide
catatttctatttagcggtattaac

SEQ ID NO: 742175 - DNA, 25 bp, Artificial sequence
  Synthetic oligonucleotide
gcgatttataatagtgggttgagaa

SEQ ID NO: 742176 - DNA, 25 bp, Artificial sequence
  Synthetic oligonucleotide
cgagaacacgtaaatggctgacaat

SEQ ID NO: 742177 - DNA, 25 bp, Artificial sequence
  Synthetic oligonucleotide
caagagcaaatctcaccaagatgag

SEQ ID NO: 742178 - DNA, 25 bp, Artificial sequence
  Synthetic oligonucleotide
ggaactttgcagcattttttgggga

SEQ ID NO: 742179 - DNA, 25 bp, Artificial sequence
  Synthetic oligonucleotide
tgacgacaacgattccgggatccga

SEQ ID NO: 742180 - DNA, 25 bp, Artificial sequence
  Synthetic oligonucleotide
catatataacttagctatccttaag

SEQ ID NO: 742181 - DNA, 25 bp, Artificial sequence
  Synthetic oligonucleotide
caagagcaaatcacaccaagatgag

SEQ ID NO: 742182 - DNA, 25 bp, Artificial sequence
  Synthetic oligonucleotide
ggtttatgtaaaccggcaatgtacg

SEQ ID NO: 742183 - DNA, 25 bp, Artificial sequence
  Synthetic oligonucleotide
cgagaacacgtatatggctgacaat

SEQ ID NO: 742184 - DNA, 25 bp, Artificial sequence
  Synthetic oligonucleotide
tgaaagaagagcaagcgacgtggcc

SEQ ID NO: 742185 - DNA, 25 bp, Artificial sequence
  Synthetic oligonucleotide
caaatgtgcatatacctctgagcgt

SEQ ID NO: 742186 - DNA, 25 bp, Artificial sequence
  Synthetic oligonucleotide
tagagagttgcaggcacccttggat

SEQ ID NO: 742187 - DNA, 25 bp, Artificial sequence
  Synthetic oligonucleotide
tagagagttgcacgcacccttggat

SEQ ID NO: 742188 - DNA, 25 bp, Artificial sequence
  Synthetic oligonucleotide
tggtggaaggattctgtaaatggca

SEQ ID NO: 742189 - DNA, 25 bp, Artificial sequence
  Synthetic oligonucleotide
tggtggaaggatactgtaaatggca

SEQ ID NO: 742190 - DNA, 25 bp, Artificial sequence
  Synthetic oligonucleotide
taaaggagaggacataactggtgaa

SEQ ID NO: 742191 - DNA, 25 bp, Artificial sequence
  Synthetic oligonucleotide
taaaggagaggagataactggtgaa

SEQ ID NO: 742192 - DNA, 25 bp, Artificial sequence
  Synthetic oligonucleotide
ggtttatgtaaagcggcaatgtacg

SEQ ID NO: 742193 - DNA, 25 bp, Artificial sequence
  Synthetic oligonucleotide
cgtcgggtatagatccttccaacgc

SEQ ID NO: 742194 - DNA, 25 bp, Artificial sequence
  Synthetic oligonucleotide
ggttgtcactaaacgacgtagcttc

SEQ ID NO: 742195 - DNA, 25 bp, Artificial sequence
  Synthetic oligonucleotide
gaaaacccgttgcaatacgcccaca

SEQ ID NO: 742196 - DNA, 25 bp, Artificial sequence
  Synthetic oligonucleotide
gaaaacccgttggaatacgcccaca

SEQ ID NO: 742197 - DNA, 25 bp, Artificial sequence
  Synthetic oligonucleotide
ggctaatatccaaatgtcccacaaa

SEQ ID NO: 742198 - DNA, 25 bp, Artificial sequence
  Synthetic oligonucleotide
tgacgacaacgaatccgggatccga

SEQ ID NO: 742199 - DNA, 25 bp, Artificial sequence
  Synthetic oligonucleotide
tattgtgtgacacatcaagcgaaac

SEQ ID NO: 742200 - DNA, 25 bp, Artificial sequence
  Synthetic oligonucleotide
ggctaatatccatatgtcccacaaa

SEQ ID NO: 742201 - DNA, 25 bp, Artificial sequence
  Synthetic oligonucleotide
cgtcgggtatagttccttccaacgc

SEQ ID NO: 742202 - DNA, 25 bp, Artificial sequence
  Synthetic oligonucleotide
acatgacgtcgtgaaagggccaccg

SEQ ID NO: 742203 - DNA, 25 bp, Artificial sequence
  Synthetic oligonucleotide
tcaaattggcaagatctaaaccgga

SEQ ID NO: 742204 - DNA, 25 bp, Artificial sequence
  Synthetic oligonucleotide
tcaaattggcaacatctaaaccgga

SEQ ID NO: 742205 - DNA, 25 bp, Artificial sequence
  Synthetic oligonucleotide
gggattggaccggttaacgaattgc

SEQ ID NO: 742206 - DNA, 25 bp, Artificial sequence
  Synthetic oligonucleotide
gggattggaccgcttaacgaattgc

SEQ ID NO: 742207 - DNA, 25 bp, Artificial sequence
  Synthetic oligonucleotide
tctgcgtttgtaacgcctctttgaa

SEQ ID NO: 742208 - DNA, 25 bp, Artificial sequence
  Synthetic oligonucleotide
ggaactttgcaggattttttgggga

SEQ ID NO: 742209 - DNA, 25 bp, Artificial sequence
  Synthetic oligonucleotide
tattgtgtgacagatcaagcgaaac

SEQ ID NO: 742210 - DNA, 25 bp, Artificial sequence
  Synthetic oligonucleotide
tccgttgccagttacatatcttagc

SEQ ID NO: 742211 - DNA, 25 bp, Artificial sequence
  Synthetic oligonucleotide
gaatcagaatggaatgggcattgtg

SEQ ID NO: 742212 - DNA, 25 bp, Artificial sequence
  Synthetic oligonucleotide
agtcatggccatatctagatcttga

SEQ ID NO: 742213 - DNA, 25 bp, Artificial sequence
  Synthetic oligonucleotide
agtcatggccatttctagatcttga

SEQ ID NO: 742214 - DNA, 25 bp, Artificial sequence
  Synthetic oligonucleotide
cattgcttttgattttacatccgga

SEQ ID NO: 742215 - DNA, 25 bp, Artificial sequence
  Synthetic oligonucleotide
cattgcttttgaatttacatccgga

SEQ ID NO: 742216 - DNA, 25 bp, Artificial sequence
  Synthetic oligonucleotide
tagaccgcaaaccatattggatcgg

SEQ ID NO: 742217 - DNA, 25 bp, Artificial sequence
  Synthetic oligonucleotide
ggttgtcactaatcgacgtagcttc

SEQ ID NO: 742218 - DNA, 25 bp, Artificial sequence
  Synthetic oligonucleotide
tccgttgccagtaacatatcttagc

SEQ ID NO: 742219 - DNA, 25 bp, Artificial sequence
  Synthetic oligonucleotide
acatgacgtcgtcaaagggccaccg

SEQ ID NO: 742220 - DNA, 25 bp, Artificial sequence
  Synthetic oligonucleotide
tctgaaagacgaagaaatgaaaagc

SEQ ID NO: 742221 - DNA, 25 bp, Artificial sequence
  Synthetic oligonucleotide
tctgaaagacgatgaaatgaaaagc

SEQ ID NO: 742222 - DNA, 25 bp, Artificial sequence
  Synthetic oligonucleotide
gatacaacgaacaagagcaacagca

SEQ ID NO: 742223 - DNA, 25 bp, Artificial sequence
  Synthetic oligonucleotide
gatacaacgaactagagcaacagca

SEQ ID NO: 742224 - DNA, 25 bp, Artificial sequence
  Synthetic oligonucleotide
cggttcagtaaaaccagaaaccata

SEQ ID NO: 742225 - DNA, 25 bp, Artificial sequence
  Synthetic oligonucleotide
cggttcagtaaatccagaaaccata

SEQ ID NO: 742226 - DNA, 25 bp, Artificial sequence
  Synthetic oligonucleotide
gaatcagaatggtatgggcattgtg

SEQ ID NO: 742227 - DNA, 25 bp, Artificial sequence
  Synthetic oligonucleotide
tagaccgcaaacgatattggatcgg

SEQ ID NO: 742228 - DNA, 25 bp, Artificial sequence
  Synthetic oligonucleotide
tgttgacccaccgaacaaccaaaaa

SEQ ID NO: 742229 - DNA, 25 bp, Artificial sequence
  Synthetic oligonucleotide
tctccaagctgggtgttttttcatc

SEQ ID NO: 742230 - DNA, 25 bp, Artificial sequence
  Synthetic oligonucleotide
tgttagatgtatcacttgaaatgcc

SEQ ID NO: 742231 - DNA, 25 bp, Artificial sequence
  Synthetic oligonucleotide
gagtcttgataagctcacgaaccaa

SEQ ID NO: 742232 - DNA, 25 bp, Artificial sequence
  Synthetic oligonucleotide
gagtcttgataacctcacgaaccaa

SEQ ID NO: 742233 - DNA, 25 bp, Artificial sequence
  Synthetic oligonucleotide
gaaaaacaaaagtatgggcccaata

SEQ ID NO: 742234 - DNA, 25 bp, Artificial sequence
  Synthetic oligonucleotide
gaaaaacaaaagaatgggcccaata

SEQ ID NO: 742235 - DNA, 25 bp, Artificial sequence
  Synthetic oligonucleotide
taacccacgtgacatgctgactgtg

SEQ ID NO: 742236 - DNA, 25 bp, Artificial sequence
  Synthetic oligonucleotide
taacccacgtgagatgctgactgtg

SEQ ID NO: 742237 - DNA, 25 bp, Artificial sequence
  Synthetic oligonucleotide
tcatcacgctcagggtttgctcctt

SEQ ID NO: 742238 - DNA, 25 bp, Artificial sequence
  Synthetic oligonucleotide
tcatcacgctcacggtttgctcctt

SEQ ID NO: 742239 - DNA, 25 bp, Artificial sequence
  Synthetic oligonucleotide
gttcatctcaaaaatccgaaactcg

SEQ ID NO: 742240 - DNA, 25 bp, Artificial sequence
  Synthetic oligonucleotide
ttattattacatattgtttttcgtc

SEQ ID NO: 742241 - DNA, 25 bp, Artificial sequence
  Synthetic oligonucleotide
gttcatctcaaatatccgaaactcg

SEQ ID NO: 742242 - DNA, 25 bp, Artificial sequence
  Synthetic oligonucleotide
tgttgacccacccaacaaccaaaaa

SEQ ID NO: 742243 - DNA, 25 bp, Artificial sequence
  Synthetic oligonucleotide
aaatctgtatctgcgtctttgatcc

SEQ ID NO: 742244 - DNA, 25 bp, Artificial sequence
  Synthetic oligonucleotide
aaatctgtatctccgtctttgatcc

SEQ ID NO: 742245 - DNA, 25 bp, Artificial sequence
  Synthetic oligonucleotide
atagacagacacacccaaaccctag

SEQ ID NO: 742246 - DNA, 25 bp, Artificial sequence
  Synthetic oligonucleotide
atagacagacactcccaaaccctag

SEQ ID NO: 742247 - DNA, 25 bp, Artificial sequence
  Synthetic oligonucleotide
gccgtcagatcagattgatcgggca

SEQ ID NO: 742248 - DNA, 25 bp, Artificial sequence
  Synthetic oligonucleotide
gccgtcagatcacattgatcgggca

SEQ ID NO: 742249 - DNA, 25 bp, Artificial sequence
  Synthetic oligonucleotide
ccgttggaatcaagcaatggtagag

SEQ ID NO: 742250 - DNA, 25 bp, Artificial sequence
  Synthetic oligonucleotide
ccgttggaatcatgcaatggtagag

SEQ ID NO: 742251 - DNA, 25 bp, Artificial sequence
  Synthetic oligonucleotide
tatttgtgggtatctagaagaggcg

SEQ ID NO: 742252 - DNA, 25 bp, Artificial sequence
  Synthetic oligonucleotide
tatttgtgggtaactagaagaggcg

SEQ ID NO: 742253 - DNA, 25 bp, Artificial sequence
  Synthetic oligonucleotide
ttattattacattttgtttttcgtc

SEQ ID NO: 742254 - DNA, 25 bp, Artificial sequence
  Synthetic oligonucleotide
taagcctggtgcagagaatgtcgaa

SEQ ID NO: 742255 - DNA, 25 bp, Artificial sequence
  Synthetic oligonucleotide
gaatctaaatcacggagacatgttt

SEQ ID NO: 742256 - DNA, 25 bp, Artificial sequence
  Synthetic oligonucleotide
gaatctaaatcagggagacatgttt

SEQ ID NO: 742257 - DNA, 25 bp, Artificial sequence
  Synthetic oligonucleotide
ccccttgttctattatttcctagat

SEQ ID NO: 742258 - DNA, 25 bp, Artificial sequence
  Synthetic oligonucleotide
ccccttgttctaatatttcctagat

SEQ ID NO: 742259 - DNA, 25 bp, Artificial sequence
  Synthetic oligonucleotide
tcttcatttagttctatataggtcc

SEQ ID NO: 742260 - DNA, 25 bp, Artificial sequence
  Synthetic oligonucleotide
tcttcatttagtactatataggtcc

SEQ ID NO: 742261 - DNA, 25 bp, Artificial sequence
  Synthetic oligonucleotide
gggattgtcctaagttacaattgga

SEQ ID NO: 742262 - DNA, 25 bp, Artificial sequence
  Synthetic oligonucleotide
gggattgtcctatgttacaattgga

SEQ ID NO: 742263 - DNA, 25 bp, Artificial sequence
  Synthetic oligonucleotide
aacggttcattcatacaatattatg

SEQ ID NO: 742264 - DNA, 25 bp, Artificial sequence
  Synthetic oligonucleotide
aacggttcattcttacaatattatg

SEQ ID NO: 742265 - DNA, 25 bp, Artificial sequence
  Synthetic oligonucleotide
tgttagatgtatgacttgaaatgcc

SEQ ID NO: 742266 - DNA, 25 bp, Artificial sequence
  Synthetic oligonucleotide
tcagacatgaataatactaccgtac

SEQ ID NO: 742267 - DNA, 25 bp, Artificial sequence
  Synthetic oligonucleotide
tgtatgtgctactataattggtcaa

SEQ ID NO: 742268 - DNA, 25 bp, Artificial sequence
  Synthetic oligonucleotide
tgtatgtgctacaataattggtcaa

SEQ ID NO: 742269 - DNA, 25 bp, Artificial sequence
  Synthetic oligonucleotide
cagtatctaatgtattttatgctag

SEQ ID NO: 742270 - DNA, 25 bp, Artificial sequence
  Synthetic oligonucleotide
cagtatctaatgaattttatgctag

SEQ ID NO: 742271 - DNA, 25 bp, Artificial sequence
  Synthetic oligonucleotide
tactgttcgactgtaacggtgttaa

SEQ ID NO: 742272 - DNA, 25 bp, Artificial sequence
  Synthetic oligonucleotide
tactgttcgactctaacggtgttaa

SEQ ID NO: 742273 - DNA, 25 bp, Artificial sequence
  Synthetic oligonucleotide
gcggttgattgatagttaatggctc

SEQ ID NO: 742274 - DNA, 25 bp, Artificial sequence
  Synthetic oligonucleotide
gcggttgattgaaagttaatggctc

SEQ ID NO: 742275 - DNA, 25 bp, Artificial sequence
  Synthetic oligonucleotide
gcccatagactaaagagtaagagta

SEQ ID NO: 742276 - DNA, 25 bp, Artificial sequence
  Synthetic oligonucleotide
gcccatagactatagagtaagagta

SEQ ID NO: 742277 - DNA, 25 bp, Artificial sequence
  Synthetic oligonucleotide
gctaacgtaaatacaaaatctttgg

SEQ ID NO: 742278 - DNA, 25 bp, Artificial sequence
  Synthetic oligonucleotide
gctaacgtaaattcaaaatctttgg

SEQ ID NO: 742279 - DNA, 25 bp, Artificial sequence
  Synthetic oligonucleotide
ggtttatgtaatctgaatctttctc

SEQ ID NO: 742280 - DNA, 25 bp, Artificial sequence
  Synthetic oligonucleotide
tttcccaaggtacaaagcaaacgct

SEQ ID NO: 742281 - DNA, 25 bp, Artificial sequence
  Synthetic oligonucleotide
agacttgttttgattgtatctgatc

SEQ ID NO: 742282 - DNA, 25 bp, Artificial sequence
  Synthetic oligonucleotide
gatgaccatgtcactttaattttgt

SEQ ID NO: 742283 - DNA, 25 bp, Artificial sequence
  Synthetic oligonucleotide
gatgaccatgtctctttaattttgt

SEQ ID NO: 742284 - DNA, 25 bp, Artificial sequence
  Synthetic oligonucleotide
gatggaccttgcataacaagttcaa

SEQ ID NO: 742285 - DNA, 25 bp, Artificial sequence
  Synthetic oligonucleotide
gatggaccttgcttaacaagttcaa

SEQ ID NO: 742286 - DNA, 25 bp, Artificial sequence
  Synthetic oligonucleotide
tataggtgtattgcgtttaggtatg

SEQ ID NO: 742287 - DNA, 25 bp, Artificial sequence
  Synthetic oligonucleotide
tataggtgtattccgtttaggtatg

SEQ ID NO: 742288 - DNA, 25 bp, Artificial sequence
  Synthetic oligonucleotide
caaagatggtaaatctgaatctggg

SEQ ID NO: 742289 - DNA, 25 bp, Artificial sequence
  Synthetic oligonucleotide
caaagatggtaattctgaatctggg

SEQ ID NO: 742290 - DNA, 25 bp, Artificial sequence
  Synthetic oligonucleotide
tgttgatgatcacctcgtctagtgg

SEQ ID NO: 742291 - DNA, 25 bp, Artificial sequence
  Synthetic oligonucleotide
agacttgttttgtttgtatctgatc

SEQ ID NO: 742292 - DNA, 25 bp, Artificial sequence
  Synthetic oligonucleotide
tttcccaaggtagaaagcaaacgct

SEQ ID NO: 742293 - DNA, 25 bp, Artificial sequence
  Synthetic oligonucleotide
agacagtcagggaggctgcagcgag

SEQ ID NO: 742294 - DNA, 25 bp, Artificial sequence
  Synthetic oligonucleotide
tgcttttgccttagtttggaaacaa

SEQ ID NO: 742295 - DNA, 25 bp, Artificial sequence
  Synthetic oligonucleotide
tgcttttgcctttgtttggaaacaa

SEQ ID NO: 742296 - DNA, 25 bp, Artificial sequence
  Synthetic oligonucleotide
ccgatgattcatatagggaggatgg

SEQ ID NO: 742297 - DNA, 25 bp, Artificial sequence
  Synthetic oligonucleotide
ccgatgattcatttagggaggatgg

SEQ ID NO: 742298 - DNA, 25 bp, Artificial sequence
  Synthetic oligonucleotide
agacagtcagggtggctgcagcgag

SEQ ID NO: 742299 - DNA, 25 bp, Artificial sequence
  Synthetic oligonucleotide
aagaagcaggagaccgtgggattct

SEQ ID NO: 742300 - DNA, 25 bp, Artificial sequence
  Synthetic oligonucleotide
ttcacgcataccctgtaagtgcagc

SEQ ID NO: 742301 - DNA, 25 bp, Artificial sequence
  Synthetic oligonucleotide
ttcacgcataccgtgtaagtgcagc

SEQ ID NO: 742302 - DNA, 25 bp, Artificial sequence
  Synthetic oligonucleotide
taagcctggtgctgagaatgtcgaa

SEQ ID NO: 742303 - DNA, 25 bp, Artificial sequence
  Synthetic oligonucleotide
tctccaagctggctgttttttcatc

SEQ ID NO: 742304 - DNA, 25 bp, Artificial sequence
  Synthetic oligonucleotide
tcagacatgaattatactaccgtac

SEQ ID NO: 742305 - DNA, 25 bp, Artificial sequence
  Synthetic oligonucleotide
tgttgatgatcagctcgtctagtgg

SEQ ID NO: 742306 - DNA, 25 bp, Artificial sequence
  Synthetic oligonucleotide
tccagcagcggtacgaggatggctc

SEQ ID NO: 742307 - DNA, 25 bp, Artificial sequence
  Synthetic oligonucleotide
actaatcgaatctcctactctaaag

SEQ ID NO: 742308 - DNA, 25 bp, Artificial sequence
  Synthetic oligonucleotide
actaatcgaatcacctactctaaag

SEQ ID NO: 742309 - DNA, 25 bp, Artificial sequence
  Synthetic oligonucleotide
aagaagcaggagtccgtgggattct

SEQ ID NO: 742310 - DNA, 25 bp, Artificial sequence
  Synthetic oligonucleotide
tttagagtcatgatttgaaaagagg

SEQ ID NO: 742311 - DNA, 25 bp, Artificial sequence
  Synthetic oligonucleotide
tctgtcatgtgtcatttggtcgcgc

SEQ ID NO: 742312 - DNA, 25 bp, Artificial sequence
  Synthetic oligonucleotide
tctgtcatgtgtgatttggtcgcgc

SEQ ID NO: 742313 - DNA, 25 bp, Artificial sequence
  Synthetic oligonucleotide
tccagcagcggttcgaggatggctc

SEQ ID NO: 742314 - DNA, 25 bp, Artificial sequence
  Synthetic oligonucleotide
ttttatccatccttgttcctttttc

SEQ ID NO: 742315 - DNA, 25 bp, Artificial sequence
  Synthetic oligonucleotide
ttttatccatccatgttcctttttc

SEQ ID NO: 742316 - DNA, 25 bp, Artificial sequence
  Synthetic oligonucleotide
tctgcgtttgtatcgcctctttgaa

SEQ ID NO: 742317 - DNA, 25 bp, Artificial sequence
  Synthetic oligonucleotide
ggtttatgtaatgtgaatctttctc

SEQ ID NO: 742318 - DNA, 25 bp, Artificial sequence
  Synthetic oligonucleotide
cgaaaattgtggttgcgattgatta

SEQ ID NO: 742319 - DNA, 25 bp, Artificial sequence
  Synthetic oligonucleotide
tatctgcttcgtgattaattgggca

SEQ ID NO: 742320 - DNA, 25 bp, Artificial sequence
  Synthetic oligonucleotide
acgtcaccttatcgaatcatgtttg

SEQ ID NO: 742321 - DNA, 25 bp, Artificial sequence
  Synthetic oligonucleotide
cgaaaattgtggatgcgattgatta

SEQ ID NO: 742322 - DNA, 25 bp, Artificial sequence
  Synthetic oligonucleotide
tgaggtgttatgtctgtaattgcaa

SEQ ID NO: 742323 - DNA, 25 bp, Artificial sequence
  Synthetic oligonucleotide
tgaggtgttatgactgtaattgcaa

SEQ ID NO: 742324 - DNA, 25 bp, Artificial sequence
  Synthetic oligonucleotide
acgtcaccttatggaatcatgtttg

SEQ ID NO: 742325 - DNA, 25 bp, Artificial sequence
  Synthetic oligonucleotide
ccctgtattgaactgattgctttga

SEQ ID NO: 742326 - DNA, 25 bp, Artificial sequence
  Synthetic oligonucleotide
tttagagtcatgttttgaaaagagg

SEQ ID NO: 742327 - DNA, 25 bp, Artificial sequence
  Synthetic oligonucleotide
ccctgtattgaagtgattgctttga

SEQ ID NO: 742328 - DNA, 25 bp, Artificial sequence
  Synthetic oligonucleotide
actgttgggaatttgttttcatgga

SEQ ID NO: 742329 - DNA, 25 bp, Artificial sequence
  Synthetic oligonucleotide
actgttgggaatatgttttcatgga

SEQ ID NO: 742330 - DNA, 25 bp, Artificial sequence
  Synthetic oligonucleotide
tatctgcttcgtcattaattgggca

SEQ ID NO: 742331 - DNA, 25 bp, Artificial sequence
  Synthetic oligonucleotide
gatgcaacttggatctagttcctgg

SEQ ID NO: 742332 - DNA, 25 bp, Artificial sequence
  Synthetic oligonucleotide
taaatgtgttagttaagagcttcac

SEQ ID NO: 742333 - DNA, 25 bp, Artificial sequence
  Synthetic oligonucleotide
gatgcaacttggttctagttcctgg

SEQ ID NO: 742334 - DNA, 25 bp, Artificial sequence
  Synthetic oligonucleotide
caaattcagaacttttcaacccata

SEQ ID NO: 742335 - DNA, 25 bp, Artificial sequence
  Synthetic oligonucleotide
caaattcagaacatttcaacccata

SEQ ID NO: 742336 - DNA, 25 bp, Artificial sequence
  Synthetic oligonucleotide
gatgatggctctagtcccctcgagt

SEQ ID NO: 742337 - DNA, 25 bp, Artificial sequence
  Synthetic oligonucleotide
gatgatggctcttgtcccctcgagt

SEQ ID NO: 742338 - DNA, 25 bp, Artificial sequence
  Synthetic oligonucleotide
cactaaattttataatgtatgaaca

SEQ ID NO: 742339 - DNA, 25 bp, Artificial sequence
  Synthetic oligonucleotide
tctgatgaatagaactaatttttat

SEQ ID NO: 742340 - DNA, 25 bp, Artificial sequence
  Synthetic oligonucleotide
tctgatgaatagtactaatttttat

SEQ ID NO: 742341 - DNA, 25 bp, Artificial sequence
  Synthetic oligonucleotide
ggtttttagccacccaatattataa

SEQ ID NO: 742342 - DNA, 25 bp, Artificial sequence
  Synthetic oligonucleotide
tatatacacataagttaatatcagt

SEQ ID NO: 742343 - DNA, 25 bp, Artificial sequence
  Synthetic oligonucleotide
taaatgtgttagataagagcttcac

SEQ ID NO: 742344 - DNA, 25 bp, Artificial sequence
  Synthetic oligonucleotide
ggtttttagccagccaatattataa

SEQ ID NO: 742345 - DNA, 25 bp, Artificial sequence
  Synthetic oligonucleotide
cactaaattttaaaatgtatgaaca

SEQ ID NO: 742346 - DNA, 25 bp, Artificial sequence
  Synthetic oligonucleotide
caactacttatcatctatatatgca

SEQ ID NO: 742347 - DNA, 25 bp, Artificial sequence
  Synthetic oligonucleotide
gatctatttatttgttgaactaaca

SEQ ID NO: 742348 - DNA, 25 bp, Artificial sequence
  Synthetic oligonucleotide
gatctatttattagttgaactaaca

SEQ ID NO: 742349 - DNA, 25 bp, Artificial sequence
  Synthetic oligonucleotide
gactactatattggagaacttttca

SEQ ID NO: 742350 - DNA, 25 bp, Artificial sequence
  Synthetic oligonucleotide
tatatacacatatgttaatatcagt

SEQ ID NO: 742351 - DNA, 25 bp, Artificial sequence
  Synthetic oligonucleotide
caactacttatcttctatatatgca

SEQ ID NO: 742352 - DNA, 25 bp, Artificial sequence
  Synthetic oligonucleotide
ttgatattctcaatcactaatggtg

SEQ ID NO: 742353 - DNA, 25 bp, Artificial sequence
  Synthetic oligonucleotide
ttgatattctcattcactaatggtg

SEQ ID NO: 742354 - DNA, 25 bp, Artificial sequence
  Synthetic oligonucleotide
gaagaacgacacgtttccgaccgga

SEQ ID NO: 742355 - DNA, 25 bp, Artificial sequence
  Synthetic oligonucleotide
gactactatattcgagaacttttca

SEQ ID NO: 742356 - DNA, 25 bp, Artificial sequence
  Synthetic oligonucleotide
ggtccatacagagttcagtttcaag

SEQ ID NO: 742357 - DNA, 25 bp, Artificial sequence
  Synthetic oligonucleotide
ggtccatacagacttcagtttcaag

SEQ ID NO: 742358 - DNA, 25 bp, Artificial sequence
  Synthetic oligonucleotide
gcgatggcaaaagaaacctattgag

SEQ ID NO: 742359 - DNA, 25 bp, Artificial sequence
  Synthetic oligonucleotide
gcgatggcaaaacaaacctattgag

SEQ ID NO: 742360 - DNA, 25 bp, Artificial sequence
  Synthetic oligonucleotide
catttatcaattcgtgcaaaaaggg

SEQ ID NO: 742361 - DNA, 25 bp, Artificial sequence
  Synthetic oligonucleotide
tgaggtatgtaatgaatttcttttc

SEQ ID NO: 742362 - DNA, 25 bp, Artificial sequence
  Synthetic oligonucleotide
tctcgccaaactttgtcctataaaa

SEQ ID NO: 742363 - DNA, 25 bp, Artificial sequence
  Synthetic oligonucleotide
catttatcaattggtgcaaaaaggg

SEQ ID NO: 742364 - DNA, 25 bp, Artificial sequence
  Synthetic oligonucleotide
agttgagccaagatggagcctgcga

SEQ ID NO: 742365 - DNA, 25 bp, Artificial sequence
  Synthetic oligonucleotide
agttgagccaagttggagcctgcga

SEQ ID NO: 742366 - DNA, 25 bp, Artificial sequence
  Synthetic oligonucleotide
tatttcctgactcgaacgttgttcc

SEQ ID NO: 742367 - DNA, 25 bp, Artificial sequence
  Synthetic oligonucleotide
tatttcctgactggaacgttgttcc

SEQ ID NO: 742368 - DNA, 25 bp, Artificial sequence
  Synthetic oligonucleotide
gatgatcgccaagttgacggtcgaa

SEQ ID NO: 742369 - DNA, 25 bp, Artificial sequence
  Synthetic oligonucleotide
gatgatcgccaacttgacggtcgaa

SEQ ID NO: 742370 - DNA, 25 bp, Artificial sequence
  Synthetic oligonucleotide
tctcgccaaactatgtcctataaaa

SEQ ID NO: 742371 - DNA, 25 bp, Artificial sequence
  Synthetic oligonucleotide
tgaggtatgtaaagaatttcttttc

SEQ ID NO: 742372 - DNA, 25 bp, Artificial sequence
  Synthetic oligonucleotide
tagacaagacgatcataaacccatg

SEQ ID NO: 742373 - DNA, 25 bp, Artificial sequence
  Synthetic oligonucleotide
catcgccagcctaaacctctgcatt

SEQ ID NO: 742374 - DNA, 25 bp, Artificial sequence
  Synthetic oligonucleotide
catcgccagccttaacctctgcatt

SEQ ID NO: 742375 - DNA, 25 bp, Artificial sequence
  Synthetic oligonucleotide
gatgcgatcatccatccggcgacgt

SEQ ID NO: 742376 - DNA, 25 bp, Artificial sequence
  Synthetic oligonucleotide
gaagaacgacacctttccgaccgga

SEQ ID NO: 742377 - DNA, 25 bp, Artificial sequence
  Synthetic oligonucleotide
tgatcctaaaaaatcctgtaaaaag

SEQ ID NO: 742378 - DNA, 25 bp, Artificial sequence
  Synthetic oligonucleotide
tgatcctaaaaattcctgtaaaaag

SEQ ID NO: 742379 - DNA, 25 bp, Artificial sequence
  Synthetic oligonucleotide
ttcttttaaaaatatattgaacata

SEQ ID NO: 742380 - DNA, 25 bp, Artificial sequence
  Synthetic oligonucleotide
gatgcgatcatcgatccggcgacgt

SEQ ID NO: 742381 - DNA, 25 bp, Artificial sequence
  Synthetic oligonucleotide
tagacaagacgaacataaacccatg

SEQ ID NO: 742382 - DNA, 25 bp, Artificial sequence
  Synthetic oligonucleotide
tatcaatcgtgtagtgtcctctcgt

SEQ ID NO: 742383 - DNA, 25 bp, Artificial sequence
  Synthetic oligonucleotide
cacaaaagtaaatgtaaatgaaaca

SEQ ID NO: 742384 - DNA, 25 bp, Artificial sequence
  Synthetic oligonucleotide
cacaaaagtaaaagtaaatgaaaca

SEQ ID NO: 742385 - DNA, 25 bp, Artificial sequence
  Synthetic oligonucleotide
tcaagggagtacaaattagcagccc

SEQ ID NO: 742386 - DNA, 25 bp, Artificial sequence
  Synthetic oligonucleotide
tcaagggagtactaattagcagccc

SEQ ID NO: 742387 - DNA, 25 bp, Artificial sequence
  Synthetic oligonucleotide
ctttttgcatattagaaagagtcca

SEQ ID NO: 742388 - DNA, 25 bp, Artificial sequence
  Synthetic oligonucleotide
ctttttgcatataagaaagagtcca

SEQ ID NO: 742389 - DNA, 25 bp, Artificial sequence
  Synthetic oligonucleotide
gacacttttatctttcctatgaatc

SEQ ID NO: 742390 - DNA, 25 bp, Artificial sequence
  Synthetic oligonucleotide
tcattaaacttctactaaatgtgtt

SEQ ID NO: 742391 - DNA, 25 bp, Artificial sequence
  Synthetic oligonucleotide
ttcttttaaaaaaatattgaacata

SEQ ID NO: 742392 - DNA, 25 bp, Artificial sequence
  Synthetic oligonucleotide
aaaaaaatagatataagtgactaga

SEQ ID NO: 742393 - DNA, 25 bp, Artificial sequence
  Synthetic oligonucleotide
tgcataaattagatatacgaagacc

SEQ ID NO: 742394 - DNA, 25 bp, Artificial sequence
  Synthetic oligonucleotide
taccatttaaaatactcaatgaggc

SEQ ID NO: 742395 - DNA, 25 bp, Artificial sequence
  Synthetic oligonucleotide
taccatttaaaaaactcaatgaggc

SEQ ID NO: 742396 - DNA, 25 bp, Artificial sequence
  Synthetic oligonucleotide
cacgtacacattaagtaattaggtt

SEQ ID NO: 742397 - DNA, 25 bp, Artificial sequence
  Synthetic oligonucleotide
cacgtacacatttagtaattaggtt

SEQ ID NO: 742398 - DNA, 25 bp, Artificial sequence
  Synthetic oligonucleotide
caattagaaccaattaatagaaact

SEQ ID NO: 742399 - DNA, 25 bp, Artificial sequence
  Synthetic oligonucleotide
caattagaaccatttaatagaaact

SEQ ID NO: 742400 - DNA, 25 bp, Artificial sequence
  Synthetic oligonucleotide
tcattaaacttcaactaaatgtgtt

SEQ ID NO: 742401 - DNA, 25 bp, Artificial sequence
  Synthetic oligonucleotide
cctgatggattggaatacattgaga

SEQ ID NO: 742402 - DNA, 25 bp, Artificial sequence
  Synthetic oligonucleotide
aaaaaaatagatttaagtgactaga

SEQ ID NO: 742403 - DNA, 25 bp, Artificial sequence
  Synthetic oligonucleotide
cctgatggattgcaatacattgaga

SEQ ID NO: 742404 - DNA, 25 bp, Artificial sequence
  Synthetic oligonucleotide
aaatcaaactactacgagtattccg

SEQ ID NO: 742405 - DNA, 25 bp, Artificial sequence
  Synthetic oligonucleotide
aaatcaaactacaacgagtattccg

SEQ ID NO: 742406 - DNA, 25 bp, Artificial sequence
  Synthetic oligonucleotide
ttgctcatctctacgtacttcccgg

SEQ ID NO: 742407 - DNA, 25 bp, Artificial sequence
  Synthetic oligonucleotide
ttgctcatctcttcgtacttcccgg

SEQ ID NO: 742408 - DNA, 25 bp, Artificial sequence
  Synthetic oligonucleotide
gtcaaagagaatgccagcgccaact

SEQ ID NO: 742409 - DNA, 25 bp, Artificial sequence
  Synthetic oligonucleotide
gtcaaagagaatcccagcgccaact

SEQ ID NO: 742410 - DNA, 25 bp, Artificial sequence
  Synthetic oligonucleotide
tatcaatcgtgttgtgtcctctcgt

SEQ ID NO: 742411 - DNA, 25 bp, Artificial sequence
  Synthetic oligonucleotide
tgcataaattagttatacgaagacc

SEQ ID NO: 742412 - DNA, 25 bp, Artificial sequence
  Synthetic oligonucleotide
gttttaagaagaaatagatttagtg

SEQ ID NO: 742413 - DNA, 25 bp, Artificial sequence
  Synthetic oligonucleotide
tgtctctatgatacttaagtctttg

SEQ ID NO: 742414 - DNA, 25 bp, Artificial sequence
  Synthetic oligonucleotide
gccaatttgggggagttatctaaaa

SEQ ID NO: 742415 - DNA, 25 bp, Artificial sequence
  Synthetic oligonucleotide
gccaatttggggcagttatctaaaa

SEQ ID NO: 742416 - DNA, 25 bp, Artificial sequence
  Synthetic oligonucleotide
caatttttcgagttgttttgctgaa

SEQ ID NO: 742417 - DNA, 25 bp, Artificial sequence
  Synthetic oligonucleotide
caatttttcgagatgttttgctgaa

SEQ ID NO: 742418 - DNA, 25 bp, Artificial sequence
  Synthetic oligonucleotide
tcttggaaagttaacaaatcacccc

SEQ ID NO: 742419 - DNA, 25 bp, Artificial sequence
  Synthetic oligonucleotide
tcttggaaagtttacaaatcacccc

SEQ ID NO: 742420 - DNA, 25 bp, Artificial sequence
  Synthetic oligonucleotide
gctttcaaacaattgggctcattga

SEQ ID NO: 742421 - DNA, 25 bp, Artificial sequence
  Synthetic oligonucleotide
gctttcaaacaaatgggctcattga

SEQ ID NO: 742422 - DNA, 25 bp, Artificial sequence
  Synthetic oligonucleotide
gcttattttggttttgagcccattc

SEQ ID NO: 742423 - DNA, 25 bp, Artificial sequence
  Synthetic oligonucleotide
gcttattttggtattgagcccattc

SEQ ID NO: 742424 - DNA, 25 bp, Artificial sequence
  Synthetic oligonucleotide
cattaaaggaaatatcccaagagtg

SEQ ID NO: 742425 - DNA, 25 bp, Artificial sequence
  Synthetic oligonucleotide
cattaaaggaaaaatcccaagagtg

SEQ ID NO: 742426 - DNA, 25 bp, Artificial sequence
  Synthetic oligonucleotide
cgcagcctttatgctcgaaacgtag

SEQ ID NO: 742427 - DNA, 25 bp, Artificial sequence
  Synthetic oligonucleotide
gttccatagaccatacatttcaaat

SEQ ID NO: 742428 - DNA, 25 bp, Artificial sequence
  Synthetic oligonucleotide
tcttttttgtggatcacgggactac

SEQ ID NO: 742429 - DNA, 25 bp, Artificial sequence
  Synthetic oligonucleotide
tgtctctatgattcttaagtctttg

SEQ ID NO: 742430 - DNA, 25 bp, Artificial sequence
  Synthetic oligonucleotide
gtgtaagaaaaatattctatagtag

SEQ ID NO: 742431 - DNA, 25 bp, Artificial sequence
  Synthetic oligonucleotide
gtgtaagaaaaaaattctatagtag

SEQ ID NO: 742432 - DNA, 25 bp, Artificial sequence
  Synthetic oligonucleotide
tgtggtgtgaaaaatccttatcttg

SEQ ID NO: 742433 - DNA, 25 bp, Artificial sequence
  Synthetic oligonucleotide
tgtggtgtgaaatatccttatcttg

SEQ ID NO: 742434 - DNA, 25 bp, Artificial sequence
  Synthetic oligonucleotide
tcaattacttacatatttttctcct

SEQ ID NO: 742435 - DNA, 25 bp, Artificial sequence
  Synthetic oligonucleotide
tcaattacttacttatttttctcct

SEQ ID NO: 742436 - DNA, 25 bp, Artificial sequence
  Synthetic oligonucleotide
caaaaaaggtttgtcattagatcgg

SEQ ID NO: 742437 - DNA, 25 bp, Artificial sequence
  Synthetic oligonucleotide
caaaaaaggtttctcattagatcgg

SEQ ID NO: 742438 - DNA, 25 bp, Artificial sequence
  Synthetic oligonucleotide
gctgccgctaatacctccgccgttt

SEQ ID NO: 742439 - DNA, 25 bp, Artificial sequence
  Synthetic oligonucleotide
gctgccgctaattcctccgccgttt

SEQ ID NO: 742440 - DNA, 25 bp, Artificial sequence
  Synthetic oligonucleotide
cgcagcctttatcctcgaaacgtag

SEQ ID NO: 742441 - DNA, 25 bp, Artificial sequence
  Synthetic oligonucleotide
gttccatagaccttacatttcaaat

SEQ ID NO: 742442 - DNA, 25 bp, Artificial sequence
  Synthetic oligonucleotide
caatgacggtgtagctgtgttcaaa

SEQ ID NO: 742443 - DNA, 25 bp, Artificial sequence
  Synthetic oligonucleotide
ttccattctctctcccaccaaacta

SEQ ID NO: 742444 - DNA, 25 bp, Artificial sequence
  Synthetic oligonucleotide
ttccattctctcacccaccaaacta

SEQ ID NO: 742445 - DNA, 25 bp, Artificial sequence
  Synthetic oligonucleotide
tcttcttcaccaacacatcagataa

SEQ ID NO: 742446 - DNA, 25 bp, Artificial sequence
  Synthetic oligonucleotide
tcttcttcaccatcacatcagataa

SEQ ID NO: 742447 - DNA, 25 bp, Artificial sequence
  Synthetic oligonucleotide
ctgtaatctcccaccgtcgctgcag

SEQ ID NO: 742448 - DNA, 25 bp, Artificial sequence
  Synthetic oligonucleotide
ctgtaatctccctccgtcgctgcag

SEQ ID NO: 742449 - DNA, 25 bp, Artificial sequence
  Synthetic oligonucleotide
ggtgacatctctcttcaaacccttt

SEQ ID NO: 742450 - DNA, 25 bp, Artificial sequence
  Synthetic oligonucleotide
ggtgacatctctgttcaaacccttt

SEQ ID NO: 742451 - DNA, 25 bp, Artificial sequence
  Synthetic oligonucleotide
caacaacgagactaggaggcttgaa

SEQ ID NO: 742452 - DNA, 25 bp, Artificial sequence
  Synthetic oligonucleotide
caacaacgagacaaggaggcttgaa

SEQ ID NO: 742453 - DNA, 25 bp, Artificial sequence
  Synthetic oligonucleotide
gacacttttatcattcctatgaatc

SEQ ID NO: 742454 - DNA, 25 bp, Artificial sequence
  Synthetic oligonucleotide
aagcttttggtgttgggtgaatgaa

SEQ ID NO: 742455 - DNA, 25 bp, Artificial sequence
  Synthetic oligonucleotide
tttggaaagagacgataagatggtt

SEQ ID NO: 742456 - DNA, 25 bp, Artificial sequence
  Synthetic oligonucleotide
aagcttttggtgatgggtgaatgaa

SEQ ID NO: 742457 - DNA, 25 bp, Artificial sequence
  Synthetic oligonucleotide
tttggaaagagaggataagatggtt

SEQ ID NO: 742458 - DNA, 25 bp, Artificial sequence
  Synthetic oligonucleotide
caatgacggtgttgctgtgttcaaa

SEQ ID NO: 742459 - DNA, 25 bp, Artificial sequence
  Synthetic oligonucleotide
taacgatggtgaacagaggaaaacg

SEQ ID NO: 742460 - DNA, 25 bp, Artificial sequence
  Synthetic oligonucleotide
taacgatggtgatcagaggaaaacg

SEQ ID NO: 742461 - DNA, 25 bp, Artificial sequence
  Synthetic oligonucleotide
tgttagaagagaagccattatcgat

SEQ ID NO: 742462 - DNA, 25 bp, Artificial sequence
  Synthetic oligonucleotide
tgttagaagagatgccattatcgat

SEQ ID NO: 742463 - DNA, 25 bp, Artificial sequence
  Synthetic oligonucleotide
gaaagaaggaagagaagaggcttaa

SEQ ID NO: 742464 - DNA, 25 bp, Artificial sequence
  Synthetic oligonucleotide
tactagtagtattaatatgttaata

SEQ ID NO: 742465 - DNA, 25 bp, Artificial sequence
  Synthetic oligonucleotide
taagggtcggtcatttttgtatgct

SEQ ID NO: 742466 - DNA, 25 bp, Artificial sequence
  Synthetic oligonucleotide
taagggtcggtcttttttgtatgct

SEQ ID NO: 742467 - DNA, 25 bp, Artificial sequence
  Synthetic oligonucleotide
tagtactagttgtgatgacagagac

SEQ ID NO: 742468 - DNA, 25 bp, Artificial sequence
  Synthetic oligonucleotide
tagtactagttgagatgacagagac

SEQ ID NO: 742469 - DNA, 25 bp, Artificial sequence
  Synthetic oligonucleotide
tcttttttgtggttcacgggactac

SEQ ID NO: 742470 - DNA, 25 bp, Artificial sequence
  Synthetic oligonucleotide
tactagtagtataaatatgttaata

SEQ ID NO: 742471 - DNA, 25 bp, Artificial sequence
  Synthetic oligonucleotide
gttttaagaagatatagatttagtg

SEQ ID NO: 742472 - DNA, 25 bp, Artificial sequence
  Synthetic oligonucleotide
tattcaattggttactaaatggtgc

SEQ ID NO: 742473 - DNA, 25 bp, Artificial sequence
  Synthetic oligonucleotide
gggttgctttcatcggtgagtttct

SEQ ID NO: 742474 - DNA, 25 bp, Artificial sequence
  Synthetic oligonucleotide
taattaaattaagttgtattccgag

SEQ ID NO: 742475 - DNA, 25 bp, Artificial sequence
  Synthetic oligonucleotide
taattaaattaacttgtattccgag

SEQ ID NO: 742476 - DNA, 25 bp, Artificial sequence
  Synthetic oligonucleotide
agttggcgcggtaagggcggctgtt

SEQ ID NO: 742477 - DNA, 25 bp, Artificial sequence
  Synthetic oligonucleotide
agttggcgcggttagggcggctgtt

SEQ ID NO: 742478 - DNA, 25 bp, Artificial sequence
  Synthetic oligonucleotide
ggctaccacatactgtataattgtt

SEQ ID NO: 742479 - DNA, 25 bp, Artificial sequence
  Synthetic oligonucleotide
ggctaccacatagtgtataattgtt

SEQ ID NO: 742480 - DNA, 25 bp, Artificial sequence
  Synthetic oligonucleotide
ttatagttagcagtctaatcgtggg

SEQ ID NO: 742481 - DNA, 25 bp, Artificial sequence
  Synthetic oligonucleotide
ttatagttagcactctaatcgtggg

SEQ ID NO: 742482 - DNA, 25 bp, Artificial sequence
  Synthetic oligonucleotide
taattatttctatgtgtggcttgca

SEQ ID NO: 742483 - DNA, 25 bp, Artificial sequence
  Synthetic oligonucleotide
taattatttctaagtgtggcttgca

SEQ ID NO: 742484 - DNA, 25 bp, Artificial sequence
  Synthetic oligonucleotide
ttccaaattaaattagtagaaagct

SEQ ID NO: 742485 - DNA, 25 bp, Artificial sequence
  Synthetic oligonucleotide
gggttgctttcaacggtgagtttct

SEQ ID NO: 742486 - DNA, 25 bp, Artificial sequence
  Synthetic oligonucleotide
ccagtcttatggtgtacttataaca

SEQ ID NO: 742487 - DNA, 25 bp, Artificial sequence
  Synthetic oligonucleotide
ccagtcttatggagtacttataaca

SEQ ID NO: 742488 - DNA, 25 bp, Artificial sequence
  Synthetic oligonucleotide
taaccaaccaatcatgtgtggtggg

SEQ ID NO: 742489 - DNA, 25 bp, Artificial sequence
  Synthetic oligonucleotide
taaccaaccaatgatgtgtggtggg

SEQ ID NO: 742490 - DNA, 25 bp, Artificial sequence
  Synthetic oligonucleotide
cttaagaaagatggaggcaaagccg

SEQ ID NO: 742491 - DNA, 25 bp, Artificial sequence
  Synthetic oligonucleotide
cttaagaaagatcgaggcaaagccg

SEQ ID NO: 742492 - DNA, 25 bp, Artificial sequence
  Synthetic oligonucleotide
tatacactatgctgatttgcattcc

SEQ ID NO: 742493 - DNA, 25 bp, Artificial sequence
  Synthetic oligonucleotide
tatacactatgcagatttgcattcc

SEQ ID NO: 742494 - DNA, 25 bp, Artificial sequence
  Synthetic oligonucleotide
tggttcgttttcttttataatcaaa

SEQ ID NO: 742495 - DNA, 25 bp, Artificial sequence
  Synthetic oligonucleotide
tggttcgttttcatttataatcaaa

SEQ ID NO: 742496 - DNA, 25 bp, Artificial sequence
  Synthetic oligonucleotide
catggtttgtgagcaaatagttatt

SEQ ID NO: 742497 - DNA, 25 bp, Artificial sequence
  Synthetic oligonucleotide
catggtttgtgaccaaatagttatt

SEQ ID NO: 742498 - DNA, 25 bp, Artificial sequence
  Synthetic oligonucleotide
taagtattttcagtcaaattcttga

SEQ ID NO: 742499 - DNA, 25 bp, Artificial sequence
  Synthetic oligonucleotide
gaaagaaggaagtgaagaggcttaa

SEQ ID NO: 742500 - DNA, 25 bp, Artificial sequence
  Synthetic oligonucleotide
ttccaaattaaaatagtagaaagct

SEQ ID NO: 742501 - DNA, 25 bp, Artificial sequence
  Synthetic oligonucleotide
gacaaaacgacagcaacagctccaa

SEQ ID NO: 742502 - DNA, 25 bp, Artificial sequence
  Synthetic oligonucleotide
catcgtgttgctatggtcgatataa

SEQ ID NO: 742503 - DNA, 25 bp, Artificial sequence
  Synthetic oligonucleotide
tctcgaagagatcaaagagtctgtc

SEQ ID NO: 742504 - DNA, 25 bp, Artificial sequence
  Synthetic oligonucleotide
tctcgaagagatgaaagagtctgtc

SEQ ID NO: 742505 - DNA, 25 bp, Artificial sequence
  Synthetic oligonucleotide
tctccaagttaatgctgttgccacg

SEQ ID NO: 742506 - DNA, 25 bp, Artificial sequence
  Synthetic oligonucleotide
tccaatactaaggagatttccgagg

SEQ ID NO: 742507 - DNA, 25 bp, Artificial sequence
  Synthetic oligonucleotide
catcgtgttgctttggtcgatataa

SEQ ID NO: 742508 - DNA, 25 bp, Artificial sequence
  Synthetic oligonucleotide
gctaatgaatgatacagtgtacagt

SEQ ID NO: 742509 - DNA, 25 bp, Artificial sequence
  Synthetic oligonucleotide
tctccaagttaaagctgttgccacg

SEQ ID NO: 742510 - DNA, 25 bp, Artificial sequence
  Synthetic oligonucleotide
gctaatgaatgaaacagtgtacagt

SEQ ID NO: 742511 - DNA, 25 bp, Artificial sequence
  Synthetic oligonucleotide
tctataatactagctatataacgag

SEQ ID NO: 742512 - DNA, 25 bp, Artificial sequence
  Synthetic oligonucleotide
taatccagctgcaagcaaactcact

SEQ ID NO: 742513 - DNA, 25 bp, Artificial sequence
  Synthetic oligonucleotide
tattcaattggtaactaaatggtgc

SEQ ID NO: 742514 - DNA, 25 bp, Artificial sequence
  Synthetic oligonucleotide
tctataatactacctatataacgag

SEQ ID NO: 742515 - DNA, 25 bp, Artificial sequence
  Synthetic oligonucleotide
taagtattttcactcaaattcttga

SEQ ID NO: 742516 - DNA, 25 bp, Artificial sequence
  Synthetic oligonucleotide
gacaaaacgacaccaacagctccaa

SEQ ID NO: 742517 - DNA, 25 bp, Artificial sequence
  Synthetic oligonucleotide
tttttggattagggtgaaaagttga

SEQ ID NO: 742518 - DNA, 25 bp, Artificial sequence
  Synthetic oligonucleotide
ttcaagtgttgaggctctttaactc

SEQ ID NO: 742519 - DNA, 25 bp, Artificial sequence
  Synthetic oligonucleotide
tggtcttccacctacctcagtaagt

SEQ ID NO: 742520 - DNA, 25 bp, Artificial sequence
  Synthetic oligonucleotide
taatccagctgctagcaaactcact

SEQ ID NO: 742521 - DNA, 25 bp, Artificial sequence
  Synthetic oligonucleotide
ttcaagtgttgacgctctttaactc

SEQ ID NO: 742522 - DNA, 25 bp, Artificial sequence
  Synthetic oligonucleotide
taataataaacatagttcatgattg

SEQ ID NO: 742523 - DNA, 25 bp, Artificial sequence
  Synthetic oligonucleotide
gggtactgctccagtgtactggaaa

SEQ ID NO: 742524 - DNA, 25 bp, Artificial sequence
  Synthetic oligonucleotide
tggtcttccaccaacctcagtaagt

SEQ ID NO: 742525 - DNA, 25 bp, Artificial sequence
  Synthetic oligonucleotide
gggtactgctcctgtgtactggaaa

SEQ ID NO: 742526 - DNA, 25 bp, Artificial sequence
  Synthetic oligonucleotide
tagatacaagctaccttcatgggcc

SEQ ID NO: 742527 - DNA, 25 bp, Artificial sequence
  Synthetic oligonucleotide
tagatacaagcttccttcatgggcc

SEQ ID NO: 742528 - DNA, 25 bp, Artificial sequence
  Synthetic oligonucleotide
tttttggattagcgtgaaaagttga

SEQ ID NO: 742529 - DNA, 25 bp, Artificial sequence
  Synthetic oligonucleotide
taataataaacaaagttcatgattg

SEQ ID NO: 742530 - DNA, 25 bp, Artificial sequence
  Synthetic oligonucleotide
tccaatactaagcagatttccgagg

SEQ ID NO: 742531 - DNA, 25 bp, Artificial sequence
  Synthetic oligonucleotide
aaaaagaacccacagtgttttcatc

SEQ ID NO: 742532 - DNA, 25 bp, Artificial sequence
  Synthetic oligonucleotide
gaatctttatgtaggttttatttgt

SEQ ID NO: 742533 - DNA, 25 bp, Artificial sequence
  Synthetic oligonucleotide
tcatcgcaatttttgctttttagtt

SEQ ID NO: 742534 - DNA, 25 bp, Artificial sequence
  Synthetic oligonucleotide
tcatcgcaatttatgctttttagtt

SEQ ID NO: 742535 - DNA, 25 bp, Artificial sequence
  Synthetic oligonucleotide
ctgtctttatctaataagtcctacc

SEQ ID NO: 742536 - DNA, 25 bp, Artificial sequence
  Synthetic oligonucleotide
ctgtctttatcttataagtcctacc

SEQ ID NO: 742537 - DNA, 25 bp, Artificial sequence
  Synthetic oligonucleotide
tgtcaaggataaggaataaacgatt

SEQ ID NO: 742538 - DNA, 25 bp, Artificial sequence
  Synthetic oligonucleotide
gaatctttatgttggttttatttgt

SEQ ID NO: 742539 - DNA, 25 bp, Artificial sequence
  Synthetic oligonucleotide
aaaaagaacccagagtgttttcatc

SEQ ID NO: 742540 - DNA, 25 bp, Artificial sequence
  Synthetic oligonucleotide
gagagtttcttggttatttgtttca

SEQ ID NO: 742541 - DNA, 25 bp, Artificial sequence
  Synthetic oligonucleotide
tgtgttttgctgcaatcactccatg

SEQ ID NO: 742542 - DNA, 25 bp, Artificial sequence
  Synthetic oligonucleotide
tccaatatattgcttaaaaataagt

SEQ ID NO: 742543 - DNA, 25 bp, Artificial sequence
  Synthetic oligonucleotide
tgaacatgtggtcggctcgattaaa

SEQ ID NO: 742544 - DNA, 25 bp, Artificial sequence
  Synthetic oligonucleotide
tgtcaaggataacgaataaacgatt

SEQ ID NO: 742545 - DNA, 25 bp, Artificial sequence
  Synthetic oligonucleotide
aactttgaattttgtctttatttca

SEQ ID NO: 742546 - DNA, 25 bp, Artificial sequence
  Synthetic oligonucleotide
tgtgttttgctggaatcactccatg

SEQ ID NO: 742547 - DNA, 25 bp, Artificial sequence
  Synthetic oligonucleotide
tgaacatgtggtgggctcgattaaa

SEQ ID NO: 742548 - DNA, 25 bp, Artificial sequence
  Synthetic oligonucleotide
gagagtttcttgcttatttgtttca

SEQ ID NO: 742549 - DNA, 25 bp, Artificial sequence
  Synthetic oligonucleotide
tttttaacgtaacaattatcattgg

SEQ ID NO: 742550 - DNA, 25 bp, Artificial sequence
  Synthetic oligonucleotide
gctttagctatgcattaggttttag

SEQ ID NO: 742551 - DNA, 25 bp, Artificial sequence
  Synthetic oligonucleotide
gctttagctatggattaggttttag

SEQ ID NO: 742552 - DNA, 25 bp, Artificial sequence
  Synthetic oligonucleotide
tacttatgtaataaacttgtggtac

SEQ ID NO: 742553 - DNA, 25 bp, Artificial sequence
  Synthetic oligonucleotide
tccaatatattggttaaaaataagt

SEQ ID NO: 742554 - DNA, 25 bp, Artificial sequence
  Synthetic oligonucleotide
aactttgaatttagtctttatttca

SEQ ID NO: 742555 - DNA, 25 bp, Artificial sequence
  Synthetic oligonucleotide
caaacatttaagattgtggttacac

SEQ ID NO: 742556 - DNA, 25 bp, Artificial sequence
  Synthetic oligonucleotide
ttttttgaataaacacttgtctttg

SEQ ID NO: 742557 - DNA, 25 bp, Artificial sequence
  Synthetic oligonucleotide
caaacatttaagtttgtggttacac

SEQ ID NO: 742558 - DNA, 25 bp, Artificial sequence
  Synthetic oligonucleotide
tttttaacgtaagaattatcattgg

SEQ ID NO: 742559 - DNA, 25 bp, Artificial sequence
  Synthetic oligonucleotide
tttgtgatccaagacgcgccttgcc

SEQ ID NO: 742560 - DNA, 25 bp, Artificial sequence
  Synthetic oligonucleotide
tgatgaattcttctaaactttaatc

SEQ ID NO: 742561 - DNA, 25 bp, Artificial sequence
  Synthetic oligonucleotide
tgatgaattcttgtaaactttaatc

SEQ ID NO: 742562 - DNA, 25 bp, Artificial sequence
  Synthetic oligonucleotide
tctaagtgaaatatctagtgactaa

SEQ ID NO: 742563 - DNA, 25 bp, Artificial sequence
  Synthetic oligonucleotide
tctaagtgaaatttctagtgactaa

SEQ ID NO: 742564 - DNA, 25 bp, Artificial sequence
  Synthetic oligonucleotide
tgaaacaggatattaatgggaagcg

SEQ ID NO: 742565 - DNA, 25 bp, Artificial sequence
  Synthetic oligonucleotide
tgaaacaggataataatgggaagcg

SEQ ID NO: 742566 - DNA, 25 bp, Artificial sequence
  Synthetic oligonucleotide
tttgtgatccaacacgcgccttgcc

SEQ ID NO: 742567 - DNA, 25 bp, Artificial sequence
  Synthetic oligonucleotide
ttttttgaataatcacttgtctttg

SEQ ID NO: 742568 - DNA, 25 bp, Artificial sequence
  Synthetic oligonucleotide
gtctgtctctctatggttttcatcc

SEQ ID NO: 742569 - DNA, 25 bp, Artificial sequence
  Synthetic oligonucleotide
gaacgcaatccgcttctgtaacgaa

SEQ ID NO: 742570 - DNA, 25 bp, Artificial sequence
  Synthetic oligonucleotide
gaacgcaatccggttctgtaacgaa

SEQ ID NO: 742571 - DNA, 25 bp, Artificial sequence
  Synthetic oligonucleotide
taaccgattttgattagtccttgaa

SEQ ID NO: 742572 - DNA, 25 bp, Artificial sequence
  Synthetic oligonucleotide
taaccgattttgtttagtccttgaa

SEQ ID NO: 742573 - DNA, 25 bp, Artificial sequence
  Synthetic oligonucleotide
tagtttatgccaaaccctctgccca

SEQ ID NO: 742574 - DNA, 25 bp, Artificial sequence
  Synthetic oligonucleotide
tagtttatgccataccctctgccca

SEQ ID NO: 742575 - DNA, 25 bp, Artificial sequence
  Synthetic oligonucleotide
gtctgtctctctttggttttcatcc

SEQ ID NO: 742576 - DNA, 25 bp, Artificial sequence
  Synthetic oligonucleotide
ttcaacacaatagatagacagagcc

SEQ ID NO: 742577 - DNA, 25 bp, Artificial sequence
  Synthetic oligonucleotide
tatacgggccggtgggattgaaacc

SEQ ID NO: 742578 - DNA, 25 bp, Artificial sequence
  Synthetic oligonucleotide
tacttatgtaattaacttgtggtac

SEQ ID NO: 742579 - DNA, 25 bp, Artificial sequence
  Synthetic oligonucleotide
gaataaattcgagcttcttctcaga

SEQ ID NO: 742580 - DNA, 25 bp, Artificial sequence
  Synthetic oligonucleotide
gaataaattcgaccttcttctcaga

SEQ ID NO: 742581 - DNA, 25 bp, Artificial sequence
  Synthetic oligonucleotide
catattcaattcacctataaggcta

SEQ ID NO: 742582 - DNA, 25 bp, Artificial sequence
  Synthetic oligonucleotide
catattcaattctcctataaggcta

SEQ ID NO: 742583 - DNA, 25 bp, Artificial sequence
  Synthetic oligonucleotide
ctagttgaaaatcacaatggtaggt

SEQ ID NO: 742584 - DNA, 25 bp, Artificial sequence
  Synthetic oligonucleotide
aaaccatctcgcattactttgaaca

SEQ ID NO: 742585 - DNA, 25 bp, Artificial sequence
  Synthetic oligonucleotide
ttcaacacaatacatagacagagcc

SEQ ID NO: 742586 - DNA, 25 bp, Artificial sequence
  Synthetic oligonucleotide
aacttactagaaacagagacccaag

SEQ ID NO: 742587 - DNA, 25 bp, Artificial sequence
  Synthetic oligonucleotide
cagatttcacatgggcaggttggat

SEQ ID NO: 742588 - DNA, 25 bp, Artificial sequence
  Synthetic oligonucleotide
cattgatcattgtctaaatattaga

SEQ ID NO: 742589 - DNA, 25 bp, Artificial sequence
  Synthetic oligonucleotide
cattgatcattgactaaatattaga

SEQ ID NO: 742590 - DNA, 25 bp, Artificial sequence
  Synthetic oligonucleotide
cttaaggaaaaattctacagaaaga

SEQ ID NO: 742591 - DNA, 25 bp, Artificial sequence
  Synthetic oligonucleotide
cttaaggaaaaaatctacagaaaga

SEQ ID NO: 742592 - DNA, 25 bp, Artificial sequence
  Synthetic oligonucleotide
tttttttaataaatagatagatcac

SEQ ID NO: 742593 - DNA, 25 bp, Artificial sequence
  Synthetic oligonucleotide
tttttttaataattagatagatcac

SEQ ID NO: 742594 - DNA, 25 bp, Artificial sequence
  Synthetic oligonucleotide
ttcaacggaaacagagcaaaaactt

SEQ ID NO: 742595 - DNA, 25 bp, Artificial sequence
  Synthetic oligonucleotide
tatttattttgcacgatccatttcg

SEQ ID NO: 742596 - DNA, 25 bp, Artificial sequence
  Synthetic oligonucleotide
ttcaacggaaactgagcaaaaactt

SEQ ID NO: 742597 - DNA, 25 bp, Artificial sequence
  Synthetic oligonucleotide
aacttactagaatcagagacccaag

SEQ ID NO: 742598 - DNA, 25 bp, Artificial sequence
  Synthetic oligonucleotide
gaaagtttagaagatcatcaagaca

SEQ ID NO: 742599 - DNA, 25 bp, Artificial sequence
  Synthetic oligonucleotide
gaaagtttagaacatcatcaagaca

SEQ ID NO: 742600 - DNA, 25 bp, Artificial sequence
  Synthetic oligonucleotide
caaagtaaagtgtaatatcagaacc

SEQ ID NO: 742601 - DNA, 25 bp, Artificial sequence
  Synthetic oligonucleotide
caaagtaaagtgaaatatcagaacc

SEQ ID NO: 742602 - DNA, 25 bp, Artificial sequence
  Synthetic oligonucleotide
tatacgggccggagggattgaaacc

SEQ ID NO: 742603 - DNA, 25 bp, Artificial sequence
  Synthetic oligonucleotide
cagatttcacatcggcaggttggat

SEQ ID NO: 742604 - DNA, 25 bp, Artificial sequence
  Synthetic oligonucleotide
tatttattttgctcgatccatttcg

SEQ ID NO: 742605 - DNA, 25 bp, Artificial sequence
  Synthetic oligonucleotide
gaaataattattttaaagaaacaaa

SEQ ID NO: 742606 - DNA, 25 bp, Artificial sequence
  Synthetic oligonucleotide
gccatcaatttgatggatccaaaca

SEQ ID NO: 742607 - DNA, 25 bp, Artificial sequence
  Synthetic oligonucleotide
gccatcaatttgttggatccaaaca

SEQ ID NO: 742608 - DNA, 25 bp, Artificial sequence
  Synthetic oligonucleotide
gagataaaagtttaagcaattacta

SEQ ID NO: 742609 - DNA, 25 bp, Artificial sequence
  Synthetic oligonucleotide
gagataaaagttaaagcaattacta

SEQ ID NO: 742610 - DNA, 25 bp, Artificial sequence
  Synthetic oligonucleotide
gacaaaaatgatacgttaaatgaat

SEQ ID NO: 742611 - DNA, 25 bp, Artificial sequence
  Synthetic oligonucleotide
gacaaaaatgattcgttaaatgaat

SEQ ID NO: 742612 - DNA, 25 bp, Artificial sequence
  Synthetic oligonucleotide
tacaagtttgtacgtaattggattc

SEQ ID NO: 742613 - DNA, 25 bp, Artificial sequence
  Synthetic oligonucleotide
tacaagtttgtaggtaattggattc

SEQ ID NO: 742614 - DNA, 25 bp, Artificial sequence
  Synthetic oligonucleotide
tacgggttctaatgaaacaattatg

SEQ ID NO: 742615 - DNA, 25 bp, Artificial sequence
  Synthetic oligonucleotide
tacgggttctaaagaaacaattatg

SEQ ID NO: 742616 - DNA, 25 bp, Artificial sequence
  Synthetic oligonucleotide
gaagatctcattttcgttatgtcgg

SEQ ID NO: 742617 - DNA, 25 bp, Artificial sequence
  Synthetic oligonucleotide
ttcttgagaagataaaaagggtcaa

SEQ ID NO: 742618 - DNA, 25 bp, Artificial sequence
  Synthetic oligonucleotide
gaaataattattataaagaaacaaa

SEQ ID NO: 742619 - DNA, 25 bp, Artificial sequence
  Synthetic oligonucleotide
cttgtgctacttgtttattagcgga

SEQ ID NO: 742620 - DNA, 25 bp, Artificial sequence
  Synthetic oligonucleotide
tactttagcttggtaccgtacgatt

SEQ ID NO: 742621 - DNA, 25 bp, Artificial sequence
  Synthetic oligonucleotide
tactttagcttgctaccgtacgatt

SEQ ID NO: 742622 - DNA, 25 bp, Artificial sequence
  Synthetic oligonucleotide
cggttgagatgataacaaatgggtc

SEQ ID NO: 742623 - DNA, 25 bp, Artificial sequence
  Synthetic oligonucleotide
cggttgagatgaaaacaaatgggtc

SEQ ID NO: 742624 - DNA, 25 bp, Artificial sequence
  Synthetic oligonucleotide
tcctgcatcagaagaagcatcaacg

SEQ ID NO: 742625 - DNA, 25 bp, Artificial sequence
  Synthetic oligonucleotide
tcctgcatcagatgaagcatcaacg

SEQ ID NO: 742626 - DNA, 25 bp, Artificial sequence
  Synthetic oligonucleotide
tatataacttctcacaagtcaccac

SEQ ID NO: 742627 - DNA, 25 bp, Artificial sequence
  Synthetic oligonucleotide
tatataacttctgacaagtcaccac

SEQ ID NO: 742628 - DNA, 25 bp, Artificial sequence
  Synthetic oligonucleotide
gaaaatatcagataaacaaaaccat

SEQ ID NO: 742629 - DNA, 25 bp, Artificial sequence
  Synthetic oligonucleotide
gaaaatatcagaaaaacaaaaccat

SEQ ID NO: 742630 - DNA, 25 bp, Artificial sequence
  Synthetic oligonucleotide
ttcttgagaagaaaaaaagggtcaa

SEQ ID NO: 742631 - DNA, 25 bp, Artificial sequence
  Synthetic oligonucleotide
gaagatctcattatcgttatgtcgg

SEQ ID NO: 742632 - DNA, 25 bp, Artificial sequence
  Synthetic oligonucleotide
catttttcttctacttgatagtaga

SEQ ID NO: 742633 - DNA, 25 bp, Artificial sequence
  Synthetic oligonucleotide
aaaacaggaattgattaatatgaag

SEQ ID NO: 742634 - DNA, 25 bp, Artificial sequence
  Synthetic oligonucleotide
aaaacaggaattcattaatatgaag

SEQ ID NO: 742635 - DNA, 25 bp, Artificial sequence
  Synthetic oligonucleotide
gaaaaatgtctaaatcttgcttggg

SEQ ID NO: 742636 - DNA, 25 bp, Artificial sequence
  Synthetic oligonucleotide
gaaaaatgtctatatcttgcttggg

SEQ ID NO: 742637 - DNA, 25 bp, Artificial sequence
  Synthetic oligonucleotide
gaggacatcgctaccaataaagaaa

SEQ ID NO: 742638 - DNA, 25 bp, Artificial sequence
  Synthetic oligonucleotide
gaggacatcgcttccaataaagaaa

SEQ ID NO: 742639 - DNA, 25 bp, Artificial sequence
  Synthetic oligonucleotide
gagtacctcgatcttttctagtttg

SEQ ID NO: 742640 - DNA, 25 bp, Artificial sequence
  Synthetic oligonucleotide
gagtacctcgatgttttctagtttg

SEQ ID NO: 742641 - DNA, 25 bp, Artificial sequence
  Synthetic oligonucleotide
aaggcagcccaatattcgataaaag

SEQ ID NO: 742642 - DNA, 25 bp, Artificial sequence
  Synthetic oligonucleotide
aaggcagcccaaaattcgataaaag

SEQ ID NO: 742643 - DNA, 25 bp, Artificial sequence
  Synthetic oligonucleotide
cacgacaatgatggcaaaaattaag

SEQ ID NO: 742644 - DNA, 25 bp, Artificial sequence
  Synthetic oligonucleotide
caacttacaaaagatatcaatatat

SEQ ID NO: 742645 - DNA, 25 bp, Artificial sequence
  Synthetic oligonucleotide
catttttcttcttcttgatagtaga

SEQ ID NO: 742646 - DNA, 25 bp, Artificial sequence
  Synthetic oligonucleotide
caacttacaaaacatatcaatatat

SEQ ID NO: 742647 - DNA, 25 bp, Artificial sequence
  Synthetic oligonucleotide
gtttctttttctttttacatataca

SEQ ID NO: 742648 - DNA, 25 bp, Artificial sequence
  Synthetic oligonucleotide
gtttctttttctatttacatataca

SEQ ID NO: 742649 - DNA, 25 bp, Artificial sequence
  Synthetic oligonucleotide
tttaatcctatcatcaaacgtgcaa

SEQ ID NO: 742650 - DNA, 25 bp, Artificial sequence
  Synthetic oligonucleotide
tatttttgtcttattggtctatcta

SEQ ID NO: 742651 - DNA, 25 bp, Artificial sequence
  Synthetic oligonucleotide
tcacatgtcgatgctaatccaacgg

SEQ ID NO: 742652 - DNA, 25 bp, Artificial sequence
  Synthetic oligonucleotide
ctagttgaaaatgacaatggtaggt

SEQ ID NO: 742653 - DNA, 25 bp, Artificial sequence
  Synthetic oligonucleotide
catttacaattaaattcactgccag

SEQ ID NO: 742654 - DNA, 25 bp, Artificial sequence
  Synthetic oligonucleotide
catttacaattatattcactgccag

SEQ ID NO: 742655 - DNA, 25 bp, Artificial sequence
  Synthetic oligonucleotide
ggtaatactaacgaaagacatctga

SEQ ID NO: 742656 - DNA, 25 bp, Artificial sequence
  Synthetic oligonucleotide
ggtaatactaaccaaagacatctga

SEQ ID NO: 742657 - DNA, 25 bp, Artificial sequence
  Synthetic oligonucleotide
cttgtgctacttctttattagcgga

SEQ ID NO: 742658 - DNA, 25 bp, Artificial sequence
  Synthetic oligonucleotide
tcacatgtcgatcctaatccaacgg

SEQ ID NO: 742659 - DNA, 25 bp, Artificial sequence
  Synthetic oligonucleotide
cacgacaatgatcgcaaaaattaag

SEQ ID NO: 742660 - DNA, 25 bp, Artificial sequence
  Synthetic oligonucleotide
ggtgttggaacatatccatgattaa

SEQ ID NO: 742661 - DNA, 25 bp, Artificial sequence
  Synthetic oligonucleotide
gctgttaaagatgttaaactcgatt

SEQ ID NO: 742662 - DNA, 25 bp, Artificial sequence
  Synthetic oligonucleotide
gctgttaaagatcttaaactcgatt

SEQ ID NO: 742663 - DNA, 25 bp, Artificial sequence
  Synthetic oligonucleotide
gaagcagaggacacagtgctcttca

SEQ ID NO: 742664 - DNA, 25 bp, Artificial sequence
  Synthetic oligonucleotide
gaagcagaggactcagtgctcttca

SEQ ID NO: 742665 - DNA, 25 bp, Artificial sequence
  Synthetic oligonucleotide
tgctctctttttcttttttatgtaa

SEQ ID NO: 742666 - DNA, 25 bp, Artificial sequence
  Synthetic oligonucleotide
tgctctctttttgttttttatgtaa

SEQ ID NO: 742667 - DNA, 25 bp, Artificial sequence
  Synthetic oligonucleotide
tattcttgccaatatgccattattg

SEQ ID NO: 742668 - DNA, 25 bp, Artificial sequence
  Synthetic oligonucleotide
tattcttgccaaaatgccattattg

SEQ ID NO: 742669 - DNA, 25 bp, Artificial sequence
  Synthetic oligonucleotide
actgtttagtattgctgtatatgaa

SEQ ID NO: 742670 - DNA, 25 bp, Artificial sequence
  Synthetic oligonucleotide
actgtttagtatagctgtatatgaa

SEQ ID NO: 742671 - DNA, 25 bp, Artificial sequence
  Synthetic oligonucleotide
tatactggggagatgcaagagagaa

SEQ ID NO: 742672 - DNA, 25 bp, Artificial sequence
  Synthetic oligonucleotide
tgtgagatacaatagggccattgat

SEQ ID NO: 742673 - DNA, 25 bp, Artificial sequence
  Synthetic oligonucleotide
ctcgttacctaatttaaggcaatgt

SEQ ID NO: 742674 - DNA, 25 bp, Artificial sequence
  Synthetic oligonucleotide
ggtgttggaacaaatccatgattaa

SEQ ID NO: 742675 - DNA, 25 bp, Artificial sequence
  Synthetic oligonucleotide
ctcgttacctaaattaaggcaatgt

SEQ ID NO: 742676 - DNA, 25 bp, Artificial sequence
  Synthetic oligonucleotide
caatggctttgattttgaatccgtg

SEQ ID NO: 742677 - DNA, 25 bp, Artificial sequence
  Synthetic oligonucleotide
aaaccatctcgctttactttgaaca

SEQ ID NO: 742678 - DNA, 25 bp, Artificial sequence
  Synthetic oligonucleotide
tatttttgtctttttggtctatcta

SEQ ID NO: 742679 - DNA, 25 bp, Artificial sequence
  Synthetic oligonucleotide
tacttttgaggaatatggtaaattc

SEQ ID NO: 742680 - DNA, 25 bp, Artificial sequence
  Synthetic oligonucleotide
tacttttgaggattatggtaaattc

SEQ ID NO: 742681 - DNA, 25 bp, Artificial sequence
  Synthetic oligonucleotide
gacaattacttcacaacgaaatgga

SEQ ID NO: 742682 - DNA, 25 bp, Artificial sequence
  Synthetic oligonucleotide
gacaattacttctcaacgaaatgga

SEQ ID NO: 742683 - DNA, 25 bp, Artificial sequence
  Synthetic oligonucleotide
taaagacaggaatatcggaatcgcc

SEQ ID NO: 742684 - DNA, 25 bp, Artificial sequence
  Synthetic oligonucleotide
tttaatcctatcttcaaacgtgcaa

SEQ ID NO: 742685 - DNA, 25 bp, Artificial sequence
  Synthetic oligonucleotide
tgtgagatacaaaagggccattgat

SEQ ID NO: 742686 - DNA, 25 bp, Artificial sequence
  Synthetic oligonucleotide
tcttcttatggtttggattctgaaa

SEQ ID NO: 742687 - DNA, 25 bp, Artificial sequence
  Synthetic oligonucleotide
caatggctttgaatttgaatccgtg

SEQ ID NO: 742688 - DNA, 25 bp, Artificial sequence
  Synthetic oligonucleotide
ttctcagagagcagcaagaacgctc

SEQ ID NO: 742689 - DNA, 25 bp, Artificial sequence
  Synthetic oligonucleotide
tatactggggagttgcaagagagaa

SEQ ID NO: 742690 - DNA, 25 bp, Artificial sequence
  Synthetic oligonucleotide
taaagacaggaaaatcggaatcgcc

SEQ ID NO: 742691 - DNA, 25 bp, Artificial sequence
  Synthetic oligonucleotide
ttctcagagagctgcaagaacgctc

SEQ ID NO: 742692 - DNA, 25 bp, Artificial sequence
  Synthetic oligonucleotide
cgagaacttagctgacaaaggagac

SEQ ID NO: 742693 - DNA, 25 bp, Artificial sequence
  Synthetic oligonucleotide
cgagaacttagcagacaaaggagac

SEQ ID NO: 742694 - DNA, 25 bp, Artificial sequence
  Synthetic oligonucleotide
acactctaccacactctggcgatga

SEQ ID NO: 742695 - DNA, 25 bp, Artificial sequence
  Synthetic oligonucleotide
ccctctggttcatatccggttctcg

SEQ ID NO: 742696 - DNA, 25 bp, Artificial sequence
  Synthetic oligonucleotide
ccctctggttcaaatccggttctcg

SEQ ID NO: 742697 - DNA, 25 bp, Artificial sequence
  Synthetic oligonucleotide
acactctaccactctctggcgatga

SEQ ID NO: 742698 - DNA, 25 bp, Artificial sequence
  Synthetic oligonucleotide
tcttcttatggtatggattctgaaa

SEQ ID NO: 742699 - DNA, 25 bp, Artificial sequence
  Synthetic oligonucleotide
gatctgtcggtttaatccggtttaa

SEQ ID NO: 742700 - DNA, 25 bp, Artificial sequence
  Synthetic oligonucleotide
catgtcttgatatgctcgacactgg

SEQ ID NO: 742701 - DNA, 25 bp, Artificial sequence
  Synthetic oligonucleotide
ggttttgttgaattaaaaaggtgca

SEQ ID NO: 742702 - DNA, 25 bp, Artificial sequence
  Synthetic oligonucleotide
ggttttgttgaaataaaaaggtgca

SEQ ID NO: 742703 - DNA, 25 bp, Artificial sequence
  Synthetic oligonucleotide
tgttcaaagactgtttggcaaagac

SEQ ID NO: 742704 - DNA, 25 bp, Artificial sequence
  Synthetic oligonucleotide
tgttcaaagactctttggcaaagac

SEQ ID NO: 742705 - DNA, 25 bp, Artificial sequence
  Synthetic oligonucleotide
gaaagaggtttttatccgaatcaac

SEQ ID NO: 742706 - DNA, 25 bp, Artificial sequence
  Synthetic oligonucleotide
gaaagaggttttaatccgaatcaac

SEQ ID NO: 742707 - DNA, 25 bp, Artificial sequence
  Synthetic oligonucleotide
catgtcttgataagctcgacactgg

SEQ ID NO: 742708 - DNA, 25 bp, Artificial sequence
  Synthetic oligonucleotide
gatctgtcggttaaatccggtttaa

SEQ ID NO: 742709 - DNA, 25 bp, Artificial sequence
  Synthetic oligonucleotide
gagattatggagaaatacggtgtca

SEQ ID NO: 742710 - DNA, 25 bp, Artificial sequence
  Synthetic oligonucleotide
gagattatggagtaatacggtgtca

SEQ ID NO: 742711 - DNA, 25 bp, Artificial sequence
  Synthetic oligonucleotide
tgcagctctcattccgttggcagag

SEQ ID NO: 742712 - DNA, 25 bp, Artificial sequence
  Synthetic oligonucleotide
tgcagctctcataccgttggcagag

SEQ ID NO: 742713 - DNA, 25 bp, Artificial sequence
  Synthetic oligonucleotide
gagatgaatggtcgattgataacgc

SEQ ID NO: 742714 - DNA, 25 bp, Artificial sequence
  Synthetic oligonucleotide
gggttaatggctcttaagccttttg

SEQ ID NO: 742715 - DNA, 25 bp, Artificial sequence
  Synthetic oligonucleotide
tataacaacacatggatctccgatc

SEQ ID NO: 742716 - DNA, 25 bp, Artificial sequence
  Synthetic oligonucleotide
gggttaatggctgttaagccttttg

SEQ ID NO: 742717 - DNA, 25 bp, Artificial sequence
  Synthetic oligonucleotide
gattgtatccagatgtctcttgacc

SEQ ID NO: 742718 - DNA, 25 bp, Artificial sequence
  Synthetic oligonucleotide
gattgtatccagttgtctcttgacc

SEQ ID NO: 742719 - DNA, 25 bp, Artificial sequence
  Synthetic oligonucleotide
gagatgaatggtggattgataacgc

SEQ ID NO: 742720 - DNA, 25 bp, Artificial sequence
  Synthetic oligonucleotide
tcaaagccaaacttattgtaaaacc

SEQ ID NO: 742721 - DNA, 25 bp, Artificial sequence
  Synthetic oligonucleotide
tcaaagccaaacatattgtaaaacc

SEQ ID NO: 742722 - DNA, 25 bp, Artificial sequence
  Synthetic oligonucleotide
tatattattaaacaatgttgaaacg

SEQ ID NO: 742723 - DNA, 25 bp, Artificial sequence
  Synthetic oligonucleotide
tatattattaaagaatgttgaaacg

SEQ ID NO: 742724 - DNA, 25 bp, Artificial sequence
  Synthetic oligonucleotide
ctttctcttgtgtatattatcaaca

SEQ ID NO: 742725 - DNA, 25 bp, Artificial sequence
  Synthetic oligonucleotide
tataacaacacaaggatctccgatc

SEQ ID NO: 742726 - DNA, 25 bp, Artificial sequence
  Synthetic oligonucleotide
tgcaattttcttttgtagctcccta

SEQ ID NO: 742727 - DNA, 25 bp, Artificial sequence
  Synthetic oligonucleotide
caaactctttttgttcatcaaacaa

SEQ ID NO: 742728 - DNA, 25 bp, Artificial sequence
  Synthetic oligonucleotide
tgcaattttcttatgtagctcccta

SEQ ID NO: 742729 - DNA, 25 bp, Artificial sequence
  Synthetic oligonucleotide
ggtttagtacgtaattaccaaatca

SEQ ID NO: 742730 - DNA, 25 bp, Artificial sequence
  Synthetic oligonucleotide
ctttctcttgtgaatattatcaaca

SEQ ID NO: 742731 - DNA, 25 bp, Artificial sequence
  Synthetic oligonucleotide
tgttggaggtgatgtaacgactctc

SEQ ID NO: 742732 - DNA, 25 bp, Artificial sequence
  Synthetic oligonucleotide
tgatttgttgatatgcagtcgctct

SEQ ID NO: 742733 - DNA, 25 bp, Artificial sequence
  Synthetic oligonucleotide
ggtttagtacgttattaccaaatca

SEQ ID NO: 742734 - DNA, 25 bp, Artificial sequence
  Synthetic oligonucleotide
gtttcaggaaacatatacaaggcgt

SEQ ID NO: 742735 - DNA, 25 bp, Artificial sequence
  Synthetic oligonucleotide
acttgcttagcttcaggttcttttt

SEQ ID NO: 742736 - DNA, 25 bp, Artificial sequence
  Synthetic oligonucleotide
acttgcttagctacaggttcttttt

SEQ ID NO: 742737 - DNA, 25 bp, Artificial sequence
  Synthetic oligonucleotide
caaactctttttcttcatcaaacaa

SEQ ID NO: 742738 - DNA, 25 bp, Artificial sequence
  Synthetic oligonucleotide
gagacttttctcttaaggtggaata

SEQ ID NO: 742739 - DNA, 25 bp, Artificial sequence
  Synthetic oligonucleotide
tgttggaggtgaagtaacgactctc

SEQ ID NO: 742740 - DNA, 25 bp, Artificial sequence
  Synthetic oligonucleotide
tcaaatgtgcttacttattgcagat

SEQ ID NO: 742741 - DNA, 25 bp, Artificial sequence
  Synthetic oligonucleotide
gaaagcagtggcatactcatcgctg

SEQ ID NO: 742742 - DNA, 25 bp, Artificial sequence
  Synthetic oligonucleotide
gaaagcagtggcttactcatcgctg

SEQ ID NO: 742743 - DNA, 25 bp, Artificial sequence
  Synthetic oligonucleotide
tgtatacagtagaaccaatcaatca

SEQ ID NO: 742744 - DNA, 25 bp, Artificial sequence
  Synthetic oligonucleotide
tgtatacagtagtaccaatcaatca

SEQ ID NO: 742745 - DNA, 25 bp, Artificial sequence
  Synthetic oligonucleotide
aacattctgctgtttttatcttagg

SEQ ID NO: 742746 - DNA, 25 bp, Artificial sequence
  Synthetic oligonucleotide
aacattctgctgattttatcttagg

SEQ ID NO: 742747 - DNA, 25 bp, Artificial sequence
  Synthetic oligonucleotide
tcaaatgtgctttcttattgcagat

SEQ ID NO: 742748 - DNA, 25 bp, Artificial sequence
  Synthetic oligonucleotide
gagacttttctcataaggtggaata

SEQ ID NO: 742749 - DNA, 25 bp, Artificial sequence
  Synthetic oligonucleotide
gatgactcttctacgaccaagatga

SEQ ID NO: 742750 - DNA, 25 bp, Artificial sequence
  Synthetic oligonucleotide
agagggaagattcatgaggattcat

SEQ ID NO: 742751 - DNA, 25 bp, Artificial sequence
  Synthetic oligonucleotide
agagggaagattgatgaggattcat

SEQ ID NO: 742752 - DNA, 25 bp, Artificial sequence
  Synthetic oligonucleotide
tgagtaaccgttcgttatcgttgac

SEQ ID NO: 742753 - DNA, 25 bp, Artificial sequence
  Synthetic oligonucleotide
tgagtaaccgttggttatcgttgac

SEQ ID NO: 742754 - DNA, 25 bp, Artificial sequence
  Synthetic oligonucleotide
tcttcgttagccgttacgctccaaa

SEQ ID NO: 742755 - DNA, 25 bp, Artificial sequence
  Synthetic oligonucleotide
tgatttgttgatttgcagtcgctct

SEQ ID NO: 742756 - DNA, 25 bp, Artificial sequence
  Synthetic oligonucleotide
tcttcgttagcccttacgctccaaa

SEQ ID NO: 742757 - DNA, 25 bp, Artificial sequence
  Synthetic oligonucleotide
cgaacgagaaacgaacgtgatggaa

SEQ ID NO: 742758 - DNA, 25 bp, Artificial sequence
  Synthetic oligonucleotide
tctgttcgcttacccgttacgaaga

SEQ ID NO: 742759 - DNA, 25 bp, Artificial sequence
  Synthetic oligonucleotide
gatgactcttcttcgaccaagatga

SEQ ID NO: 742760 - DNA, 25 bp, Artificial sequence
  Synthetic oligonucleotide
gagaatcgttcctaaaattacagcg

SEQ ID NO: 742761 - DNA, 25 bp, Artificial sequence
  Synthetic oligonucleotide
gagaatcgttccaaaaattacagcg

SEQ ID NO: 742762 - DNA, 25 bp, Artificial sequence
  Synthetic oligonucleotide
gagtgacgatcctgaagttaaagaa

SEQ ID NO: 742763 - DNA, 25 bp, Artificial sequence
  Synthetic oligonucleotide
gagtgacgatccagaagttaaagaa

SEQ ID NO: 742764 - DNA, 25 bp, Artificial sequence
  Synthetic oligonucleotide
gtttcaggaaacttatacaaggcgt

SEQ ID NO: 742765 - DNA, 25 bp, Artificial sequence
  Synthetic oligonucleotide
taaggcgtttaagatcattgaccac

SEQ ID NO: 742766 - DNA, 25 bp, Artificial sequence
  Synthetic oligonucleotide
cgaacgagaaaccaacgtgatggaa

SEQ ID NO: 742767 - DNA, 25 bp, Artificial sequence
  Synthetic oligonucleotide
tacagagagagacagggctatagat

SEQ ID NO: 742768 - DNA, 25 bp, Artificial sequence
  Synthetic oligonucleotide
gaaaaaggaaactacgcataagagt

SEQ ID NO: 742769 - DNA, 25 bp, Artificial sequence
  Synthetic oligonucleotide
gtaccgttacgctgaaccctaatca

SEQ ID NO: 742770 - DNA, 25 bp, Artificial sequence
  Synthetic oligonucleotide
gtaccgttacgcagaaccctaatca

SEQ ID NO: 742771 - DNA, 25 bp, Artificial sequence
  Synthetic oligonucleotide
gagaaaaaaggatatccctaacaca

SEQ ID NO: 742772 - DNA, 25 bp, Artificial sequence
  Synthetic oligonucleotide
gagaaaaaaggaaatccctaacaca

SEQ ID NO: 742773 - DNA, 25 bp, Artificial sequence
  Synthetic oligonucleotide
tatagaatagcctcatcgtttaagt

SEQ ID NO: 742774 - DNA, 25 bp, Artificial sequence
  Synthetic oligonucleotide
tatagaatagccacatcgtttaagt

SEQ ID NO: 742775 - DNA, 25 bp, Artificial sequence
  Synthetic oligonucleotide
tgggtgataaaaacggcaattgacg

SEQ ID NO: 742776 - DNA, 25 bp, Artificial sequence
  Synthetic oligonucleotide
gatcatcacaaagaaaaacctagag

SEQ ID NO: 742777 - DNA, 25 bp, Artificial sequence
  Synthetic oligonucleotide
tgggtgataaaatcggcaattgacg

SEQ ID NO: 742778 - DNA, 25 bp, Artificial sequence
  Synthetic oligonucleotide
tacagagagagagagggctatagat

SEQ ID NO: 742779 - DNA, 25 bp, Artificial sequence
  Synthetic oligonucleotide
aatttcatgctctctgatttctccg

SEQ ID NO: 742780 - DNA, 25 bp, Artificial sequence
  Synthetic oligonucleotide
aatttcatgctcactgatttctccg

SEQ ID NO: 742781 - DNA, 25 bp, Artificial sequence
  Synthetic oligonucleotide
ttcgtttagaatgattacgctagcc

SEQ ID NO: 742782 - DNA, 25 bp, Artificial sequence
  Synthetic oligonucleotide
ttcgtttagaatcattacgctagcc

SEQ ID NO: 742783 - DNA, 25 bp, Artificial sequence
  Synthetic oligonucleotide
tctgttcgcttagccgttacgaaga

SEQ ID NO: 742784 - DNA, 25 bp, Artificial sequence
  Synthetic oligonucleotide
gaaaaaggaaacaacgcataagagt

SEQ ID NO: 742785 - DNA, 25 bp, Artificial sequence
  Synthetic oligonucleotide
gatcatcacaaacaaaaacctagag

SEQ ID NO: 742786 - DNA, 25 bp, Artificial sequence
  Synthetic oligonucleotide
tttttatgtatatatgtctttgacc

SEQ ID NO: 742787 - DNA, 25 bp, Artificial sequence
  Synthetic oligonucleotide
taacttggaggacttcatgaagatg

SEQ ID NO: 742788 - DNA, 25 bp, Artificial sequence
  Synthetic oligonucleotide
cctcttacggctaagtataaatcaa

SEQ ID NO: 742789 - DNA, 25 bp, Artificial sequence
  Synthetic oligonucleotide
cctcttacggcttagtataaatcaa

SEQ ID NO: 742790 - DNA, 25 bp, Artificial sequence
  Synthetic oligonucleotide
gaataatatttgttaatcaccttga

SEQ ID NO: 742791 - DNA, 25 bp, Artificial sequence
  Synthetic oligonucleotide
gaataatatttgataatcaccttga

SEQ ID NO: 742792 - DNA, 25 bp, Artificial sequence
  Synthetic oligonucleotide
gaagtttgatttgtggcttggtcga

SEQ ID NO: 742793 - DNA, 25 bp, Artificial sequence
  Synthetic oligonucleotide
gaagtttgatttctggcttggtcga

SEQ ID NO: 742794 - DNA, 25 bp, Artificial sequence
  Synthetic oligonucleotide
gtataaaaataaaaatgtaattcac

SEQ ID NO: 742795 - DNA, 25 bp, Artificial sequence
  Synthetic oligonucleotide
gtataaaaataataatgtaattcac

SEQ ID NO: 742796 - DNA, 25 bp, Artificial sequence
  Synthetic oligonucleotide
tgaatatgtaaatgtccttgaacga

SEQ ID NO: 742797 - DNA, 25 bp, Artificial sequence
  Synthetic oligonucleotide
ggaagctccatcactaccatttcaa

SEQ ID NO: 742798 - DNA, 25 bp, Artificial sequence
  Synthetic oligonucleotide
tttttatgtataaatgtctttgacc

SEQ ID NO: 742799 - DNA, 25 bp, Artificial sequence
  Synthetic oligonucleotide
catgtttttgccttaacctacgcag

SEQ ID NO: 742800 - DNA, 25 bp, Artificial sequence
  Synthetic oligonucleotide
tgtaaaatatgaaccagaaacgatg

SEQ ID NO: 742801 - DNA, 25 bp, Artificial sequence
  Synthetic oligonucleotide
tgtaaaatatgatccagaaacgatg

SEQ ID NO: 742802 - DNA, 25 bp, Artificial sequence
  Synthetic oligonucleotide
gatacttacatataaccaaacgacg

SEQ ID NO: 742803 - DNA, 25 bp, Artificial sequence
  Synthetic oligonucleotide
gatacttacataaaaccaaacgacg

SEQ ID NO: 742804 - DNA, 25 bp, Artificial sequence
  Synthetic oligonucleotide
taaatctcaaaacactggaaacgac

SEQ ID NO: 742805 - DNA, 25 bp, Artificial sequence
  Synthetic oligonucleotide
taaatctcaaaagactggaaacgac

SEQ ID NO: 742806 - DNA, 25 bp, Artificial sequence
  Synthetic oligonucleotide
ccgtgacctggtaaccggagcgtaa

SEQ ID NO: 742807 - DNA, 25 bp, Artificial sequence
  Synthetic oligonucleotide
ccgtgacctggttaccggagcgtaa

SEQ ID NO: 742808 - DNA, 25 bp, Artificial sequence
  Synthetic oligonucleotide
aattggacaattatgagaaagacgg

SEQ ID NO: 742809 - DNA, 25 bp, Artificial sequence
  Synthetic oligonucleotide
aattggacaattttgagaaagacgg

SEQ ID NO: 742810 - DNA, 25 bp, Artificial sequence
  Synthetic oligonucleotide
ggaagctccatctctaccatttcaa

SEQ ID NO: 742811 - DNA, 25 bp, Artificial sequence
  Synthetic oligonucleotide
tgaatatgtaaaagtccttgaacga

SEQ ID NO: 742812 - DNA, 25 bp, Artificial sequence
  Synthetic oligonucleotide
tgtgaataaatcaaaacctgtcatt

SEQ ID NO: 742813 - DNA, 25 bp, Artificial sequence
  Synthetic oligonucleotide
catggtttagatgattgtacgtaga

SEQ ID NO: 742814 - DNA, 25 bp, Artificial sequence
  Synthetic oligonucleotide
catggtttagatcattgtacgtaga

SEQ ID NO: 742815 - DNA, 25 bp, Artificial sequence
  Synthetic oligonucleotide
tagtttggtcatcttcattgttgca

SEQ ID NO: 742816 - DNA, 25 bp, Artificial sequence
  Synthetic oligonucleotide
tagtttggtcatgttcattgttgca

SEQ ID NO: 742817 - DNA, 25 bp, Artificial sequence
  Synthetic oligonucleotide
ttgatggcagaactagataaaaacc

SEQ ID NO: 742818 - DNA, 25 bp, Artificial sequence
  Synthetic oligonucleotide
ttgatggcagaagtagataaaaacc

SEQ ID NO: 742819 - DNA, 25 bp, Artificial sequence
  Synthetic oligonucleotide
catagatttcgacgaatttgtgcat

SEQ ID NO: 742820 - DNA, 25 bp, Artificial sequence
  Synthetic oligonucleotide
catagatttcgaggaatttgtgcat

SEQ ID NO: 742821 - DNA, 25 bp, Artificial sequence
  Synthetic oligonucleotide
caaattcggagatcgagactccata

SEQ ID NO: 742822 - DNA, 25 bp, Artificial sequence
  Synthetic oligonucleotide
caaattcggagaacgagactccata

SEQ ID NO: 742823 - DNA, 25 bp, Artificial sequence
  Synthetic oligonucleotide
taaggcgtttaacatcattgaccac

SEQ ID NO: 742824 - DNA, 25 bp, Artificial sequence
  Synthetic oligonucleotide
taacttggaggagttcatgaagatg

SEQ ID NO: 742825 - DNA, 25 bp, Artificial sequence
  Synthetic oligonucleotide
tattatctttttatgtttggattga

SEQ ID NO: 742826 - DNA, 25 bp, Artificial sequence
  Synthetic oligonucleotide
catgtttttgccataacctacgcag

SEQ ID NO: 742827 - DNA, 25 bp, Artificial sequence
  Synthetic oligonucleotide
gtttgactggactacttttggaatg

SEQ ID NO: 742828 - DNA, 25 bp, Artificial sequence
  Synthetic oligonucleotide
gaaccttcctctaattcactacttg

SEQ ID NO: 742829 - DNA, 25 bp, Artificial sequence
  Synthetic oligonucleotide
cacctcgtgatataaagatgattgc

SEQ ID NO: 742830 - DNA, 25 bp, Artificial sequence
  Synthetic oligonucleotide
cacctcgtgataaaaagatgattgc

SEQ ID NO: 742831 - DNA, 25 bp, Artificial sequence
  Synthetic oligonucleotide
gggagaaaatttgacagataatgat

SEQ ID NO: 742832 - DNA, 25 bp, Artificial sequence
  Synthetic oligonucleotide
gggagaaaatttcacagataatgat

SEQ ID NO: 742833 - DNA, 25 bp, Artificial sequence
  Synthetic oligonucleotide
gatcgaagaagcagaccgtgacagt

SEQ ID NO: 742834 - DNA, 25 bp, Artificial sequence
  Synthetic oligonucleotide
gatcgaagaagctgaccgtgacagt

SEQ ID NO: 742835 - DNA, 25 bp, Artificial sequence
  Synthetic oligonucleotide
taattttgcgttatatctataatcg

SEQ ID NO: 742836 - DNA, 25 bp, Artificial sequence
  Synthetic oligonucleotide
taattttgcgttttatctataatcg

SEQ ID NO: 742837 - DNA, 25 bp, Artificial sequence
  Synthetic oligonucleotide
gtttgactggacaacttttggaatg

SEQ ID NO: 742838 - DNA, 25 bp, Artificial sequence
  Synthetic oligonucleotide
tgtgaataaatctaaacctgtcatt

SEQ ID NO: 742839 - DNA, 25 bp, Artificial sequence
  Synthetic oligonucleotide
ctctgtggtagaagaaggtttggaa

SEQ ID NO: 742840 - DNA, 25 bp, Artificial sequence
  Synthetic oligonucleotide
ttcattgtttgattgatatcatcgg

SEQ ID NO: 742841 - DNA, 25 bp, Artificial sequence
  Synthetic oligonucleotide
ttcattgtttgaatgatatcatcgg

SEQ ID NO: 742842 - DNA, 25 bp, Artificial sequence
  Synthetic oligonucleotide
cgtttgttattgttcttgttgtacc

SEQ ID NO: 742843 - DNA, 25 bp, Artificial sequence
  Synthetic oligonucleotide
cgtttgttattgatcttgttgtacc

SEQ ID NO: 742844 - DNA, 25 bp, Artificial sequence
  Synthetic oligonucleotide
tggtattaactttcatgttcttccc

SEQ ID NO: 742845 - DNA, 25 bp, Artificial sequence
  Synthetic oligonucleotide
tggtattaacttacatgttcttccc

SEQ ID NO: 742846 - DNA, 25 bp, Artificial sequence
  Synthetic oligonucleotide
tgttcaacgtcttttgtgtctacag

SEQ ID NO: 742847 - DNA, 25 bp, Artificial sequence
  Synthetic oligonucleotide
tgttcaacgtctattgtgtctacag

SEQ ID NO: 742848 - DNA, 25 bp, Artificial sequence
  Synthetic oligonucleotide
gcagatagagaacgagctatggtta

SEQ ID NO: 742849 - DNA, 25 bp, Artificial sequence
  Synthetic oligonucleotide
gcagatagagaaggagctatggtta

SEQ ID NO: 742850 - DNA, 25 bp, Artificial sequence
  Synthetic oligonucleotide
ggcaagcaacaaacaactggaacca

SEQ ID NO: 742851 - DNA, 25 bp, Artificial sequence
  Synthetic oligonucleotide
gattcacttgctaggttcatcatga

SEQ ID NO: 742852 - DNA, 25 bp, Artificial sequence
  Synthetic oligonucleotide
ctctgtggtagatgaaggtttggaa

SEQ ID NO: 742853 - DNA, 25 bp, Artificial sequence
  Synthetic oligonucleotide
tgaccgatgtttgccttccgttact

SEQ ID NO: 742854 - DNA, 25 bp, Artificial sequence
  Synthetic oligonucleotide
cggaaaagaagataagacatctcat

SEQ ID NO: 742855 - DNA, 25 bp, Artificial sequence
  Synthetic oligonucleotide
cggaaaagaagaaaagacatctcat

SEQ ID NO: 742856 - DNA, 25 bp, Artificial sequence
  Synthetic oligonucleotide
tgaccgatgtttcccttccgttact

SEQ ID NO: 742857 - DNA, 25 bp, Artificial sequence
  Synthetic oligonucleotide
ggagaatcttctgtatccgcacgcg

SEQ ID NO: 742858 - DNA, 25 bp, Artificial sequence
  Synthetic oligonucleotide
tacgagcttccttcaaagaaggttg

SEQ ID NO: 742859 - DNA, 25 bp, Artificial sequence
  Synthetic oligonucleotide
tacgagcttcctacaaagaaggttg

SEQ ID NO: 742860 - DNA, 25 bp, Artificial sequence
  Synthetic oligonucleotide
taatcaatctgcaattgtcaagtca

SEQ ID NO: 742861 - DNA, 25 bp, Artificial sequence
  Synthetic oligonucleotide
taatcaatctgctattgtcaagtca

SEQ ID NO: 742862 - DNA, 25 bp, Artificial sequence
  Synthetic oligonucleotide
gaaccttcctcttattcactacttg

SEQ ID NO: 742863 - DNA, 25 bp, Artificial sequence
  Synthetic oligonucleotide
tctcgttccaggatttaattttgag

SEQ ID NO: 742864 - DNA, 25 bp, Artificial sequence
  Synthetic oligonucleotide
tattatctttttttgtttggattga

SEQ ID NO: 742865 - DNA, 25 bp, Artificial sequence
  Synthetic oligonucleotide
ggcaagcaacaatcaactggaacca

SEQ ID NO: 742866 - DNA, 25 bp, Artificial sequence
  Synthetic oligonucleotide
gcatttctacctggccgtggatcgt

SEQ ID NO: 742867 - DNA, 25 bp, Artificial sequence
  Synthetic oligonucleotide
tctcgttccaggttttaattttgag

SEQ ID NO: 742868 - DNA, 25 bp, Artificial sequence
  Synthetic oligonucleotide
ggattatctcataccttctaacaaa

SEQ ID NO: 742869 - DNA, 25 bp, Artificial sequence
  Synthetic oligonucleotide
ggagaatcttctctatccgcacgcg

SEQ ID NO: 742870 - DNA, 25 bp, Artificial sequence
  Synthetic oligonucleotide
gattcacttgcttggttcatcatga

SEQ ID NO: 742871 - DNA, 25 bp, Artificial sequence
  Synthetic oligonucleotide
ggattatctcattccttctaacaaa

SEQ ID NO: 742872 - DNA, 25 bp, Artificial sequence
  Synthetic oligonucleotide
caatttgtttttttggtttgcagtc

SEQ ID NO: 742873 - DNA, 25 bp, Artificial sequence
  Synthetic oligonucleotide
gcatttctacctcgccgtggatcgt

SEQ ID NO: 742874 - DNA, 25 bp, Artificial sequence
  Synthetic oligonucleotide
caaaatggtaagtaaattgtatcaa

SEQ ID NO: 742875 - DNA, 25 bp, Artificial sequence
  Synthetic oligonucleotide
caaaatggtaagaaaattgtatcaa

SEQ ID NO: 742876 - DNA, 25 bp, Artificial sequence
  Synthetic oligonucleotide
tcatcaagactgtgattctgaatcg

SEQ ID NO: 742877 - DNA, 25 bp, Artificial sequence
  Synthetic oligonucleotide
tcatcaagactgagattctgaatcg

SEQ ID NO: 742878 - DNA, 25 bp, Artificial sequence
  Synthetic oligonucleotide
aactttggatgtgggcacaggagac

SEQ ID NO: 742879 - DNA, 25 bp, Artificial sequence
  Synthetic oligonucleotide
ccttagccgctttggtatctctctc

SEQ ID NO: 742880 - DNA, 25 bp, Artificial sequence
  Synthetic oligonucleotide
tttaactttcattgctgaggcatgt

SEQ ID NO: 742881 - DNA, 25 bp, Artificial sequence
  Synthetic oligonucleotide
ctttggtatttgttttgaaaagacc

SEQ ID NO: 742882 - DNA, 25 bp, Artificial sequence
  Synthetic oligonucleotide
tttaactttcatagctgaggcatgt

SEQ ID NO: 742883 - DNA, 25 bp, Artificial sequence
  Synthetic oligonucleotide
caatttgtttttatggtttgcagtc

SEQ ID NO: 742884 - DNA, 25 bp, Artificial sequence
  Synthetic oligonucleotide
aactttggatgtcggcacaggagac

SEQ ID NO: 742885 - DNA, 25 bp, Artificial sequence
  Synthetic oligonucleotide
ctttggtatttgatttgaaaagacc

SEQ ID NO: 742886 - DNA, 25 bp, Artificial sequence
  Synthetic oligonucleotide
ccttagccgcttaggtatctctctc

SEQ ID NO: 742887 - DNA, 25 bp, Artificial sequence
  Synthetic oligonucleotide
gtctgttcttccatatccactcttc

SEQ ID NO: 742888 - DNA, 25 bp, Artificial sequence
  Synthetic oligonucleotide
gtctgttcttccttatccactcttc

SEQ ID NO: 742889 - DNA, 25 bp, Artificial sequence
  Synthetic oligonucleotide
tagtctgttgcacctctcgtgacga

SEQ ID NO: 742890 - DNA, 25 bp, Artificial sequence
  Synthetic oligonucleotide
tagtctgttgcagctctcgtgacga

SEQ ID NO: 742891 - DNA, 25 bp, Artificial sequence
  Synthetic oligonucleotide
tattaggcgttctaggtcgtcgtcc

SEQ ID NO: 742892 - DNA, 25 bp, Artificial sequence
  Synthetic oligonucleotide
tattaggcgttcaaggtcgtcgtcc

SEQ ID NO: 742893 - DNA, 25 bp, Artificial sequence
  Synthetic oligonucleotide
aaacaagtgtacttagagattccgg

SEQ ID NO: 742894 - DNA, 25 bp, Artificial sequence
  Synthetic oligonucleotide
gagagggaagaggaaggaggaagat

SEQ ID NO: 742895 - DNA, 25 bp, Artificial sequence
  Synthetic oligonucleotide
gctgcaactattactactaccattt

SEQ ID NO: 742896 - DNA, 25 bp, Artificial sequence
  Synthetic oligonucleotide
cgccaatgcctaacagaggaggatt

SEQ ID NO: 742897 - DNA, 25 bp, Artificial sequence
  Synthetic oligonucleotide
gagcatccctgcgatggcttagtag

SEQ ID NO: 742898 - DNA, 25 bp, Artificial sequence
  Synthetic oligonucleotide
cgccaatgcctatcagaggaggatt

SEQ ID NO: 742899 - DNA, 25 bp, Artificial sequence
  Synthetic oligonucleotide
gagcatccctgccatggcttagtag

SEQ ID NO: 742900 - DNA, 25 bp, Artificial sequence
  Synthetic oligonucleotide
aaacaagtgtacatagagattccgg

SEQ ID NO: 742901 - DNA, 25 bp, Artificial sequence
  Synthetic oligonucleotide
gctgcaactatttctactaccattt

SEQ ID NO: 742902 - DNA, 25 bp, Artificial sequence
  Synthetic oligonucleotide
tatgtttttgtttttcatcttctcc

SEQ ID NO: 742903 - DNA, 25 bp, Artificial sequence
  Synthetic oligonucleotide
gagagggaagagcaaggaggaagat

SEQ ID NO: 742904 - DNA, 25 bp, Artificial sequence
  Synthetic oligonucleotide
ggtcaccgtttaactgttttattca

SEQ ID NO: 742905 - DNA, 25 bp, Artificial sequence
  Synthetic oligonucleotide
ggtcaccgtttatctgttttattca

SEQ ID NO: 742906 - DNA, 25 bp, Artificial sequence
  Synthetic oligonucleotide
gatttgattgctagaaccgtgaccg

SEQ ID NO: 742907 - DNA, 25 bp, Artificial sequence
  Synthetic oligonucleotide
tcccggttcacctccgagtagagcg

SEQ ID NO: 742908 - DNA, 25 bp, Artificial sequence
  Synthetic oligonucleotide
taaagatgcagtatttaaaagaaga

SEQ ID NO: 742909 - DNA, 25 bp, Artificial sequence
  Synthetic oligonucleotide
taaagatgcagtttttaaaagaaga

SEQ ID NO: 742910 - DNA, 25 bp, Artificial sequence
  Synthetic oligonucleotide
tatgtttttgttattcatcttctcc

SEQ ID NO: 742911 - DNA, 25 bp, Artificial sequence
  Synthetic oligonucleotide
caatccaatctcaccaaactctcct

SEQ ID NO: 742912 - DNA, 25 bp, Artificial sequence
  Synthetic oligonucleotide
gtttatccacaccatacacatttcg

SEQ ID NO: 742913 - DNA, 25 bp, Artificial sequence
  Synthetic oligonucleotide
tattcgtttggtgtttttctgggtc

SEQ ID NO: 742914 - DNA, 25 bp, Artificial sequence
  Synthetic oligonucleotide
tctgcctctgcttcagaagattctg

SEQ ID NO: 742915 - DNA, 25 bp, Artificial sequence
  Synthetic oligonucleotide
actttgctgtgaactctttaggagg

SEQ ID NO: 742916 - DNA, 25 bp, Artificial sequence
  Synthetic oligonucleotide
actttgctgtgatctctttaggagg

SEQ ID NO: 742917 - DNA, 25 bp, Artificial sequence
  Synthetic oligonucleotide
aatagggcagttactatcatcatcc

SEQ ID NO: 742918 - DNA, 25 bp, Artificial sequence
  Synthetic oligonucleotide
aatagggcagtttctatcatcatcc

SEQ ID NO: 742919 - DNA, 25 bp, Artificial sequence
  Synthetic oligonucleotide
tagcccaagatggtcgttttcgaga

SEQ ID NO: 742920 - DNA, 25 bp, Artificial sequence
  Synthetic oligonucleotide
tagcccaagatgctcgttttcgaga

SEQ ID NO: 742921 - DNA, 25 bp, Artificial sequence
  Synthetic oligonucleotide
gatttgattgcttgaaccgtgaccg

SEQ ID NO: 742922 - DNA, 25 bp, Artificial sequence
  Synthetic oligonucleotide
caatccaatctctccaaactctcct

SEQ ID NO: 742923 - DNA, 25 bp, Artificial sequence
  Synthetic oligonucleotide
gccatattcggcaaccgggtttcca

SEQ ID NO: 742924 - DNA, 25 bp, Artificial sequence
  Synthetic oligonucleotide
gccatattcggctaccgggtttcca

SEQ ID NO: 742925 - DNA, 25 bp, Artificial sequence
  Synthetic oligonucleotide
tcatcatcgtcgacttcccgtggtt

SEQ ID NO: 742926 - DNA, 25 bp, Artificial sequence
  Synthetic oligonucleotide
tcatcatcgtcgtcttcccgtggtt

SEQ ID NO: 742927 - DNA, 25 bp, Artificial sequence
  Synthetic oligonucleotide
aaatttggactctactcgcctgcag

SEQ ID NO: 742928 - DNA, 25 bp, Artificial sequence
  Synthetic oligonucleotide
aaatttggactcaactcgcctgcag

SEQ ID NO: 742929 - DNA, 25 bp, Artificial sequence
  Synthetic oligonucleotide
tcccggttcaccaccgagtagagcg

SEQ ID NO: 742930 - DNA, 25 bp, Artificial sequence
  Synthetic oligonucleotide
tcttccaattaacagagatgtttcg

SEQ ID NO: 742931 - DNA, 25 bp, Artificial sequence
  Synthetic oligonucleotide
tgttggtcagcaattccaaacacca

SEQ ID NO: 742932 - DNA, 25 bp, Artificial sequence
  Synthetic oligonucleotide
catgtaggtggccatcatatttgca

SEQ ID NO: 742933 - DNA, 25 bp, Artificial sequence
  Synthetic oligonucleotide
catgtaggtggcgatcatatttgca

SEQ ID NO: 742934 - DNA, 25 bp, Artificial sequence
  Synthetic oligonucleotide
gtatcacgtccaacaacttattgtt

SEQ ID NO: 742935 - DNA, 25 bp, Artificial sequence
  Synthetic oligonucleotide
gtatcacgtccatcaacttattgtt

SEQ ID NO: 742936 - DNA, 25 bp, Artificial sequence
  Synthetic oligonucleotide
tgttggtcagcatttccaaacacca

SEQ ID NO: 742937 - DNA, 25 bp, Artificial sequence
  Synthetic oligonucleotide
gtttatccacacgatacacatttcg

SEQ ID NO: 742938 - DNA, 25 bp, Artificial sequence
  Synthetic oligonucleotide
tcgtgaaccccctccgtattgcaat

SEQ ID NO: 742939 - DNA, 25 bp, Artificial sequence
  Synthetic oligonucleotide
tatgaaacagttccatttgatccac

SEQ ID NO: 742940 - DNA, 25 bp, Artificial sequence
  Synthetic oligonucleotide
ggtgaatatatgatgttgggtacaa

SEQ ID NO: 742941 - DNA, 25 bp, Artificial sequence
  Synthetic oligonucleotide
tcttccaattaagagagatgtttcg

SEQ ID NO: 742942 - DNA, 25 bp, Artificial sequence
  Synthetic oligonucleotide
gttccagtcatcatccattttttcg

SEQ ID NO: 742943 - DNA, 25 bp, Artificial sequence
  Synthetic oligonucleotide
gttccagtcatcttccattttttcg

SEQ ID NO: 742944 - DNA, 25 bp, Artificial sequence
  Synthetic oligonucleotide
aaatcagttatgacaatggtccatg

SEQ ID NO: 742945 - DNA, 25 bp, Artificial sequence
  Synthetic oligonucleotide
aaatcagttatgtcaatggtccatg

SEQ ID NO: 742946 - DNA, 25 bp, Artificial sequence
  Synthetic oligonucleotide
gccacacaagcaagcgtttttaata

SEQ ID NO: 742947 - DNA, 25 bp, Artificial sequence
  Synthetic oligonucleotide
tctgcctctgctacagaagattctg

SEQ ID NO: 742948 - DNA, 25 bp, Artificial sequence
  Synthetic oligonucleotide
tatgaaacagttgcatttgatccac

SEQ ID NO: 742949 - DNA, 25 bp, Artificial sequence
  Synthetic oligonucleotide
tagtaatgtttaattttcttggtga

SEQ ID NO: 742950 - DNA, 25 bp, Artificial sequence
  Synthetic oligonucleotide
actgtttcatatataactaagaggg

SEQ ID NO: 742951 - DNA, 25 bp, Artificial sequence
  Synthetic oligonucleotide
actgtttcatatttaactaagaggg

SEQ ID NO: 742952 - DNA, 25 bp, Artificial sequence
  Synthetic oligonucleotide
gaagctgtaaaattttcttgggaag

SEQ ID NO: 742953 - DNA, 25 bp, Artificial sequence
  Synthetic oligonucleotide
gaagctgtaaaaatttcttgggaag

SEQ ID NO: 742954 - DNA, 25 bp, Artificial sequence
  Synthetic oligonucleotide
ctggtttctatcttctcgttgtaat

SEQ ID NO: 742955 - DNA, 25 bp, Artificial sequence
  Synthetic oligonucleotide
ctggtttctatcatctcgttgtaat

SEQ ID NO: 742956 - DNA, 25 bp, Artificial sequence
  Synthetic oligonucleotide
caacttggatttatcttctttcaga

SEQ ID NO: 742957 - DNA, 25 bp, Artificial sequence
  Synthetic oligonucleotide
tcgtgaacccccaccgtattgcaat

SEQ ID NO: 742958 - DNA, 25 bp, Artificial sequence
  Synthetic oligonucleotide
tagtaatgtttatttttcttggtga

SEQ ID NO: 742959 - DNA, 25 bp, Artificial sequence
  Synthetic oligonucleotide
tattcgtttggtctttttctgggtc

SEQ ID NO: 742960 - DNA, 25 bp, Artificial sequence
  Synthetic oligonucleotide
tctctcacctttctatatcaatgct

SEQ ID NO: 742961 - DNA, 25 bp, Artificial sequence
  Synthetic oligonucleotide
tctctcacctttgtatatcaatgct

SEQ ID NO: 742962 - DNA, 25 bp, Artificial sequence
  Synthetic oligonucleotide
caatcatatatgatgtcttacaaga

SEQ ID NO: 742963 - DNA, 25 bp, Artificial sequence
  Synthetic oligonucleotide
caatcatatatgttgtcttacaaga

SEQ ID NO: 742964 - DNA, 25 bp, Artificial sequence
  Synthetic oligonucleotide
ttaaactttgtttaccactcgaaca

SEQ ID NO: 742965 - DNA, 25 bp, Artificial sequence
  Synthetic oligonucleotide
ttaaactttgttaaccactcgaaca

SEQ ID NO: 742966 - DNA, 25 bp, Artificial sequence
  Synthetic oligonucleotide
ggtgaatatatgttgttgggtacaa

SEQ ID NO: 742967 - DNA, 25 bp, Artificial sequence
  Synthetic oligonucleotide
caacttggatttttcttctttcaga

SEQ ID NO: 742968 - DNA, 25 bp, Artificial sequence
  Synthetic oligonucleotide
gaatgatctactatttcttcctcac

SEQ ID NO: 742969 - DNA, 25 bp, Artificial sequence
  Synthetic oligonucleotide
gaatcattgcaagcttcagcagaac

SEQ ID NO: 742970 - DNA, 25 bp, Artificial sequence
  Synthetic oligonucleotide
tctcatagatgttagatctgtgctt

SEQ ID NO: 742971 - DNA, 25 bp, Artificial sequence
  Synthetic oligonucleotide
tctcatagatgtaagatctgtgctt

SEQ ID NO: 742972 - DNA, 25 bp, Artificial sequence
  Synthetic oligonucleotide
catcgttttttgtgtcttggttgaa

SEQ ID NO: 742973 - DNA, 25 bp, Artificial sequence
  Synthetic oligonucleotide
catcgttttttgagtcttggttgaa

SEQ ID NO: 742974 - DNA, 25 bp, Artificial sequence
  Synthetic oligonucleotide
tcaaaacttctcagtgttgttctat

SEQ ID NO: 742975 - DNA, 25 bp, Artificial sequence
  Synthetic oligonucleotide
tcaaaacttctctgtgttgttctat

SEQ ID NO: 742976 - DNA, 25 bp, Artificial sequence
  Synthetic oligonucleotide
cgtatgaattttgaattttctcgga

SEQ ID NO: 742977 - DNA, 25 bp, Artificial sequence
  Synthetic oligonucleotide
cgtatgaattttcaattttctcgga

SEQ ID NO: 742978 - DNA, 25 bp, Artificial sequence
  Synthetic oligonucleotide
ggcttagccatagggtcaaacttca

SEQ ID NO: 742979 - DNA, 25 bp, Artificial sequence
  Synthetic oligonucleotide
ggcttagccatacggtcaaacttca

SEQ ID NO: 742980 - DNA, 25 bp, Artificial sequence
  Synthetic oligonucleotide
gaagttactttagcttttgttcatc

SEQ ID NO: 742981 - DNA, 25 bp, Artificial sequence
  Synthetic oligonucleotide
tttcaaaaatcctttttatagccga

SEQ ID NO: 742982 - DNA, 25 bp, Artificial sequence
  Synthetic oligonucleotide
gtttcttaagttgctttcatggcgg

SEQ ID NO: 742983 - DNA, 25 bp, Artificial sequence
  Synthetic oligonucleotide
gaatgatctactttttcttcctcac

SEQ ID NO: 742984 - DNA, 25 bp, Artificial sequence
  Synthetic oligonucleotide
gaatttggctaataaatcaaagagg

SEQ ID NO: 742985 - DNA, 25 bp, Artificial sequence
  Synthetic oligonucleotide
gaatttggctaaaaaatcaaagagg

SEQ ID NO: 742986 - DNA, 25 bp, Artificial sequence
  Synthetic oligonucleotide
gaattcagatcccttgttttcttcg

SEQ ID NO: 742987 - DNA, 25 bp, Artificial sequence
  Synthetic oligonucleotide
gaattcagatccgttgttttcttcg

SEQ ID NO: 742988 - DNA, 25 bp, Artificial sequence
  Synthetic oligonucleotide
gagaatttctcacatcttataaagt

SEQ ID NO: 742989 - DNA, 25 bp, Artificial sequence
  Synthetic oligonucleotide
gagaatttctcagatcttataaagt

SEQ ID NO: 742990 - DNA, 25 bp, Artificial sequence
  Synthetic oligonucleotide
tgctctgtgatgcatctgatctgat

SEQ ID NO: 742991 - DNA, 25 bp, Artificial sequence
  Synthetic oligonucleotide
tgctctgtgatggatctgatctgat

SEQ ID NO: 742992 - DNA, 25 bp, Artificial sequence
  Synthetic oligonucleotide
tcaggcgttcttgtgtggatcagag

SEQ ID NO: 742993 - DNA, 25 bp, Artificial sequence
  Synthetic oligonucleotide
tcaggcgttcttctgtggatcagag

SEQ ID NO: 742994 - DNA, 25 bp, Artificial sequence
  Synthetic oligonucleotide
tttcaaaaatccattttatagccga

SEQ ID NO: 742995 - DNA, 25 bp, Artificial sequence
  Synthetic oligonucleotide
tacttataaaaattagaaatgcatg

SEQ ID NO: 742996 - DNA, 25 bp, Artificial sequence
  Synthetic oligonucleotide
tagtatacaattttataggtgcaat

SEQ ID NO: 742997 - DNA, 25 bp, Artificial sequence
  Synthetic oligonucleotide
tagtatacaattatataggtgcaat

SEQ ID NO: 742998 - DNA, 25 bp, Artificial sequence
  Synthetic oligonucleotide
ttaccaaacaaatacaataattatg

SEQ ID NO: 742999 - DNA, 25 bp, Artificial sequence
  Synthetic oligonucleotide
ttaccaaacaaaaacaataattatg

SEQ ID NO: 743000 - DNA, 25 bp, Artificial sequence
  Synthetic oligonucleotide
ggaatgatatcttatgttagaggaa

SEQ ID NO: 743001 - DNA, 25 bp, Artificial sequence
  Synthetic oligonucleotide
ggaatgatatctaatgttagaggaa

SEQ ID NO: 743002 - DNA, 25 bp, Artificial sequence
  Synthetic oligonucleotide
caccaaaaaaagagaaaacaagaga

SEQ ID NO: 743003 - DNA, 25 bp, Artificial sequence
  Synthetic oligonucleotide
caccaaaaaaagtgaaaacaagaga

SEQ ID NO: 743004 - DNA, 25 bp, Artificial sequence
  Synthetic oligonucleotide
tctgatgttaaatactaaaaagaga

SEQ ID NO: 743005 - DNA, 25 bp, Artificial sequence
  Synthetic oligonucleotide
tctgatgttaaaaactaaaaagaga

SEQ ID NO: 743006 - DNA, 25 bp, Artificial sequence
  Synthetic oligonucleotide
cattagtaatgttgaccaatagaat

SEQ ID NO: 743007 - DNA, 25 bp, Artificial sequence
  Synthetic oligonucleotide
gaagttactttaccttttgttcatc

SEQ ID NO: 743008 - DNA, 25 bp, Artificial sequence
  Synthetic oligonucleotide
tacttataaaaaatagaaatgcatg

SEQ ID NO: 743009 - DNA, 25 bp, Artificial sequence
  Synthetic oligonucleotide
gtttcttaagttcctttcatggcgg

SEQ ID NO: 743010 - DNA, 25 bp, Artificial sequence
  Synthetic oligonucleotide
caaatatcactaatacgacgccgag

SEQ ID NO: 743011 - DNA, 25 bp, Artificial sequence
  Synthetic oligonucleotide
caaatatcactattacgacgccgag

SEQ ID NO: 743012 - DNA, 25 bp, Artificial sequence
  Synthetic oligonucleotide
caactttccagtttgatatactatt

SEQ ID NO: 743013 - DNA, 25 bp, Artificial sequence
  Synthetic oligonucleotide
caactttccagtatgatatactatt

SEQ ID NO: 743014 - DNA, 25 bp, Artificial sequence
  Synthetic oligonucleotide
gcaaaaattcccaattccacgaaac

SEQ ID NO: 743015 - DNA, 25 bp, Artificial sequence
  Synthetic oligonucleotide
gcaaaaattccctattccacgaaac

SEQ ID NO: 743016 - DNA, 25 bp, Artificial sequence
  Synthetic oligonucleotide
ttcatgttgtctacaacctcaccca

SEQ ID NO: 743017 - DNA, 25 bp, Artificial sequence
  Synthetic oligonucleotide
ttcatgttgtcttcaacctcaccca

SEQ ID NO: 743018 - DNA, 25 bp, Artificial sequence
  Synthetic oligonucleotide
ggtctcatccttttataaaatcccc

SEQ ID NO: 743019 - DNA, 25 bp, Artificial sequence
  Synthetic oligonucleotide
ggtctcatccttatataaaatcccc

SEQ ID NO: 743020 - DNA, 25 bp, Artificial sequence
  Synthetic oligonucleotide
ccggagattttttctcaggtacatc

SEQ ID NO: 743021 - DNA, 25 bp, Artificial sequence
  Synthetic oligonucleotide
cattagtaatgtagaccaatagaat

SEQ ID NO: 743022 - DNA, 25 bp, Artificial sequence
  Synthetic oligonucleotide
ccagtgattagatacaaaagtgttt

SEQ ID NO: 743023 - DNA, 25 bp, Artificial sequence
  Synthetic oligonucleotide
caactatgatagtataactatttgc

SEQ ID NO: 743024 - DNA, 25 bp, Artificial sequence
  Synthetic oligonucleotide
caactatgatagaataactatttgc

SEQ ID NO: 743025 - DNA, 25 bp, Artificial sequence
  Synthetic oligonucleotide
aattaaaaacaaagatgccattccg

SEQ ID NO: 743026 - DNA, 25 bp, Artificial sequence
  Synthetic oligonucleotide
aattaaaaacaatgatgccattccg

SEQ ID NO: 743027 - DNA, 25 bp, Artificial sequence
  Synthetic oligonucleotide
taagcgagttaggattcactggaaa

SEQ ID NO: 743028 - DNA, 25 bp, Artificial sequence
  Synthetic oligonucleotide
taagcgagttagcattcactggaaa

SEQ ID NO: 743029 - DNA, 25 bp, Artificial sequence
  Synthetic oligonucleotide
gcgaaaatctctaatctttaaaatt

SEQ ID NO: 743030 - DNA, 25 bp, Artificial sequence
  Synthetic oligonucleotide
gcgaaaatctcttatctttaaaatt

SEQ ID NO: 743031 - DNA, 25 bp, Artificial sequence
  Synthetic oligonucleotide
tacacagttagaacaaatcttgttt

SEQ ID NO: 743032 - DNA, 25 bp, Artificial sequence
  Synthetic oligonucleotide
caagttcacaatatttattgataaa

SEQ ID NO: 743033 - DNA, 25 bp, Artificial sequence
  Synthetic oligonucleotide
ggtgatttaaatcatcctcctttaa

SEQ ID NO: 743034 - DNA, 25 bp, Artificial sequence
  Synthetic oligonucleotide
gacacgtttctatggaagccagcaa

SEQ ID NO: 743035 - DNA, 25 bp, Artificial sequence
  Synthetic oligonucleotide
ccagtgattagaaacaaaagtgttt

SEQ ID NO: 743036 - DNA, 25 bp, Artificial sequence
  Synthetic oligonucleotide
tacacagttagatcaaatcttgttt

SEQ ID NO: 743037 - DNA, 25 bp, Artificial sequence
  Synthetic oligonucleotide
tgctatctgtagtcaagctgcagcc

SEQ ID NO: 743038 - DNA, 25 bp, Artificial sequence
  Synthetic oligonucleotide
tgctatctgtagacaagctgcagcc

SEQ ID NO: 743039 - DNA, 25 bp, Artificial sequence
  Synthetic oligonucleotide
tgtgattctaaagctggtgctgagc

SEQ ID NO: 743040 - DNA, 25 bp, Artificial sequence
  Synthetic oligonucleotide
tgtgattctaaacctggtgctgagc

SEQ ID NO: 743041 - DNA, 25 bp, Artificial sequence
  Synthetic oligonucleotide
cattcgtagaaaggtatgcttttga

SEQ ID NO: 743042 - DNA, 25 bp, Artificial sequence
  Synthetic oligonucleotide
cattcgtagaaacgtatgcttttga

SEQ ID NO: 743043 - DNA, 25 bp, Artificial sequence
  Synthetic oligonucleotide
cacttcaggctacatgttgtgatag

SEQ ID NO: 743044 - DNA, 25 bp, Artificial sequence
  Synthetic oligonucleotide
cacttcaggctagatgttgtgatag

SEQ ID NO: 743045 - DNA, 25 bp, Artificial sequence
  Synthetic oligonucleotide
gaatcattgcaaccttcagcagaac

SEQ ID NO: 743046 - DNA, 25 bp, Artificial sequence
  Synthetic oligonucleotide
ccggagatttttactcaggtacatc

SEQ ID NO: 743047 - DNA, 25 bp, Artificial sequence
  Synthetic oligonucleotide
tgattaacttttctacacctcaagt

SEQ ID NO: 743048 - DNA, 25 bp, Artificial sequence
  Synthetic oligonucleotide
ggtgatttaaatgatcctcctttaa

SEQ ID NO: 743049 - DNA, 25 bp, Artificial sequence
  Synthetic oligonucleotide
aacgttattcgtgctcttagattac

SEQ ID NO: 743050 - DNA, 25 bp, Artificial sequence
  Synthetic oligonucleotide
tatatatgtatatttgtttggtacg

SEQ ID NO: 743051 - DNA, 25 bp, Artificial sequence
  Synthetic oligonucleotide
tcatggctccaatcaatattatagg

SEQ ID NO: 743052 - DNA, 25 bp, Artificial sequence
  Synthetic oligonucleotide
tcatggctccaaacaatattatagg

SEQ ID NO: 743053 - DNA, 25 bp, Artificial sequence
  Synthetic oligonucleotide
ttgtcaaacttaatctttttaattc

SEQ ID NO: 743054 - DNA, 25 bp, Artificial sequence
  Synthetic oligonucleotide
ttgtcaaacttattctttttaattc

SEQ ID NO: 743055 - DNA, 25 bp, Artificial sequence
  Synthetic oligonucleotide
tatatatgtataattgtttggtacg

SEQ ID NO: 743056 - DNA, 25 bp, Artificial sequence
  Synthetic oligonucleotide
aagacaaataaataaaaatagaatc

SEQ ID NO: 743057 - DNA, 25 bp, Artificial sequence
  Synthetic oligonucleotide
tttgtcctaagcctcgacgtgttgg

SEQ ID NO: 743058 - DNA, 25 bp, Artificial sequence
  Synthetic oligonucleotide
aacgttattcgtcctcttagattac

SEQ ID NO: 743059 - DNA, 25 bp, Artificial sequence
  Synthetic oligonucleotide
gacacgtttctaaggaagccagcaa

SEQ ID NO: 743060 - DNA, 25 bp, Artificial sequence
  Synthetic oligonucleotide
tttgtcctaagcgtcgacgtgttgg

SEQ ID NO: 743061 - DNA, 25 bp, Artificial sequence
  Synthetic oligonucleotide
caagttcacaatttttattgataaa

SEQ ID NO: 743062 - DNA, 25 bp, Artificial sequence
  Synthetic oligonucleotide
aggagatgatgggatttgaccgtaa

SEQ ID NO: 743063 - DNA, 25 bp, Artificial sequence
  Synthetic oligonucleotide
aggagatgatggcatttgaccgtaa

SEQ ID NO: 743064 - DNA, 25 bp, Artificial sequence
  Synthetic oligonucleotide
tgattaacttttgtacacctcaagt

SEQ ID NO: 743065 - DNA, 25 bp, Artificial sequence
  Synthetic oligonucleotide
tgaataaagaaaacatcggagccgg

SEQ ID NO: 743066 - DNA, 25 bp, Artificial sequence
  Synthetic oligonucleotide
cctatagtaagtaatataaggaatg

SEQ ID NO: 743067 - DNA, 25 bp, Artificial sequence
  Synthetic oligonucleotide
tgaataaagaaatcatcggagccgg

SEQ ID NO: 743068 - DNA, 25 bp, Artificial sequence
  Synthetic oligonucleotide
tctggtcaaaatctcaaacttcact

SEQ ID NO: 743069 - DNA, 25 bp, Artificial sequence
  Synthetic oligonucleotide
tctggtcaaaatgtcaaacttcact

SEQ ID NO: 743070 - DNA, 25 bp, Artificial sequence
  Synthetic oligonucleotide
gccacacaagcatgcgtttttaata

SEQ ID NO: 743071 - DNA, 25 bp, Artificial sequence
  Synthetic oligonucleotide
aagacaaataaaaaaaaatagaatc

SEQ ID NO: 743072 - DNA, 25 bp, Artificial sequence
  Synthetic oligonucleotide
aggatctactagaaaaaaataatag

SEQ ID NO: 743073 - DNA, 25 bp, Artificial sequence
  Synthetic oligonucleotide
taaaccctagatacccatgtgaatg

SEQ ID NO: 743074 - DNA, 25 bp, Artificial sequence
  Synthetic oligonucleotide
taaaccctagattcccatgtgaatg

SEQ ID NO: 743075 - DNA, 25 bp, Artificial sequence
  Synthetic oligonucleotide
cctatagtaagttatataaggaatg

SEQ ID NO: 743076 - DNA, 25 bp, Artificial sequence
  Synthetic oligonucleotide
aggatctactagtaaaaaataatag

SEQ ID NO: 743077 - DNA, 25 bp, Artificial sequence
  Synthetic oligonucleotide
caatttgatttacttgatgtgtacc

SEQ ID NO: 743078 - DNA, 25 bp, Artificial sequence
  Synthetic oligonucleotide
tccaatccattgaataacgagtaag

SEQ ID NO: 743079 - DNA, 25 bp, Artificial sequence
  Synthetic oligonucleotide
tccaatccattgtataacgagtaag

SEQ ID NO: 743080 - DNA, 25 bp, Artificial sequence
  Synthetic oligonucleotide
gctgcatcgtaaaaccctaaatctt

SEQ ID NO: 743081 - DNA, 25 bp, Artificial sequence
  Synthetic oligonucleotide
gctgcatcgtaataccctaaatctt

SEQ ID NO: 743082 - DNA, 25 bp, Artificial sequence
  Synthetic oligonucleotide
catgaaagatatacttatgattgag

SEQ ID NO: 743083 - DNA, 25 bp, Artificial sequence
  Synthetic oligonucleotide
tatgttaaaattgatactttgtttc

SEQ ID NO: 743084 - DNA, 25 bp, Artificial sequence
  Synthetic oligonucleotide
catgaaagatattcttatgattgag

SEQ ID NO: 743085 - DNA, 25 bp, Artificial sequence
  Synthetic oligonucleotide
caatttgatttagttgatgtgtacc

SEQ ID NO: 743086 - DNA, 25 bp, Artificial sequence
  Synthetic oligonucleotide
tgttttgtaataaacttgtgcaagc

SEQ ID NO: 743087 - DNA, 25 bp, Artificial sequence
  Synthetic oligonucleotide
gatgaattatttatagaacacgaga

SEQ ID NO: 743088 - DNA, 25 bp, Artificial sequence
  Synthetic oligonucleotide
tttttaccgcggtaagtattgaata

SEQ ID NO: 743089 - DNA, 25 bp, Artificial sequence
  Synthetic oligonucleotide
tatgttaaaattcatactttgtttc

SEQ ID NO: 743090 - DNA, 25 bp, Artificial sequence
  Synthetic oligonucleotide
tgttttgtaatatacttgtgcaagc

SEQ ID NO: 743091 - DNA, 25 bp, Artificial sequence
  Synthetic oligonucleotide
gatgaattatttttagaacacgaga

SEQ ID NO: 743092 - DNA, 25 bp, Artificial sequence
  Synthetic oligonucleotide
tttgttctaacgtaacagaactgag

SEQ ID NO: 743093 - DNA, 25 bp, Artificial sequence
  Synthetic oligonucleotide
tttgttctaacgaaacagaactgag

SEQ ID NO: 743094 - DNA, 25 bp, Artificial sequence
  Synthetic oligonucleotide
tctattctctatggtaaccaaaagg

SEQ ID NO: 743095 - DNA, 25 bp, Artificial sequence
  Synthetic oligonucleotide
taaaagagaaaaggatgttcgcgcg

SEQ ID NO: 743096 - DNA, 25 bp, Artificial sequence
  Synthetic oligonucleotide
gggagaaaccaatcaaattccatgt

SEQ ID NO: 743097 - DNA, 25 bp, Artificial sequence
  Synthetic oligonucleotide
tttttaccgcggaaagtattgaata

SEQ ID NO: 743098 - DNA, 25 bp, Artificial sequence
  Synthetic oligonucleotide
ttgcttcataaaataggattcgatc

SEQ ID NO: 743099 - DNA, 25 bp, Artificial sequence
  Synthetic oligonucleotide
ttgcttcataaattaggattcgatc

SEQ ID NO: 743100 - DNA, 25 bp, Artificial sequence
  Synthetic oligonucleotide
taaaagagaaaacgatgttcgcgcg

SEQ ID NO: 743101 - DNA, 25 bp, Artificial sequence
  Synthetic oligonucleotide
tctattctctatcgtaaccaaaagg

SEQ ID NO: 743102 - DNA, 25 bp, Artificial sequence
  Synthetic oligonucleotide
tagtaacaggccgacataataaccc

SEQ ID NO: 743103 - DNA, 25 bp, Artificial sequence
  Synthetic oligonucleotide
aagtccagaattagtatccgttata

SEQ ID NO: 743104 - DNA, 25 bp, Artificial sequence
  Synthetic oligonucleotide
gggagaaaccaaacaaattccatgt

SEQ ID NO: 743105 - DNA, 25 bp, Artificial sequence
  Synthetic oligonucleotide
tacagtgcggaagaagacaaaaccc

SEQ ID NO: 743106 - DNA, 25 bp, Artificial sequence
  Synthetic oligonucleotide
cactttttagatatatgtgatcaca

SEQ ID NO: 743107 - DNA, 25 bp, Artificial sequence
  Synthetic oligonucleotide
tgaaaattccataaaacagcaccaa

SEQ ID NO: 743108 - DNA, 25 bp, Artificial sequence
  Synthetic oligonucleotide
tagtaacaggcccacataataaccc

SEQ ID NO: 743109 - DNA, 25 bp, Artificial sequence
  Synthetic oligonucleotide
gattaaaaatagaaacacactgacc

SEQ ID NO: 743110 - DNA, 25 bp, Artificial sequence
  Synthetic oligonucleotide
caagaaagatataaaaaaaactcat

SEQ ID NO: 743111 - DNA, 25 bp, Artificial sequence
  Synthetic oligonucleotide
caagaaagatattaaaaaaactcat

SEQ ID NO: 743112 - DNA, 25 bp, Artificial sequence
  Synthetic oligonucleotide
gtctctataaaacatccaactctca

SEQ ID NO: 743113 - DNA, 25 bp, Artificial sequence
  Synthetic oligonucleotide
gtctctataaaagatccaactctca

SEQ ID NO: 743114 - DNA, 25 bp, Artificial sequence
  Synthetic oligonucleotide
aaatcacatttccactctccttgaa

SEQ ID NO: 743115 - DNA, 25 bp, Artificial sequence
  Synthetic oligonucleotide
aaatcacatttcgactctccttgaa

SEQ ID NO: 743116 - DNA, 25 bp, Artificial sequence
  Synthetic oligonucleotide
aaaaaactacatggatcatcgataa

SEQ ID NO: 743117 - DNA, 25 bp, Artificial sequence
  Synthetic oligonucleotide
aaaaaactacatcgatcatcgataa

SEQ ID NO: 743118 - DNA, 25 bp, Artificial sequence
  Synthetic oligonucleotide
gattaaaaatagtaacacactgacc

SEQ ID NO: 743119 - DNA, 25 bp, Artificial sequence
  Synthetic oligonucleotide
tactatattctcaaaacgatggtgt

SEQ ID NO: 743120 - DNA, 25 bp, Artificial sequence
  Synthetic oligonucleotide
aagtccagaatttgtatccgttata

SEQ ID NO: 743121 - DNA, 25 bp, Artificial sequence
  Synthetic oligonucleotide
tacagtgcggaacaagacaaaaccc

SEQ ID NO: 743122 - DNA, 25 bp, Artificial sequence
  Synthetic oligonucleotide
gcaaagtggttggaccaactttagg

SEQ ID NO: 743123 - DNA, 25 bp, Artificial sequence
  Synthetic oligonucleotide
gcaaagtggttgcaccaactttagg

SEQ ID NO: 743124 - DNA, 25 bp, Artificial sequence
  Synthetic oligonucleotide
tgataaccggaaacatcgagtggcc

SEQ ID NO: 743125 - DNA, 25 bp, Artificial sequence
  Synthetic oligonucleotide
tgataaccggaatcatcgagtggcc

SEQ ID NO: 743126 - DNA, 25 bp, Artificial sequence
  Synthetic oligonucleotide
tgtatatctttaaacacgccaaggg

SEQ ID NO: 743127 - DNA, 25 bp, Artificial sequence
  Synthetic oligonucleotide
tgtatatctttatacacgccaaggg

SEQ ID NO: 743128 - DNA, 25 bp, Artificial sequence
  Synthetic oligonucleotide
gggtcatccggccagaaaagtttat

SEQ ID NO: 743129 - DNA, 25 bp, Artificial sequence
  Synthetic oligonucleotide
gggtcatccggcgagaaaagtttat

SEQ ID NO: 743130 - DNA, 25 bp, Artificial sequence
  Synthetic oligonucleotide
gatctattcccaattgactttcttg

SEQ ID NO: 743131 - DNA, 25 bp, Artificial sequence
  Synthetic oligonucleotide
gatctattcccatttgactttcttg

SEQ ID NO: 743132 - DNA, 25 bp, Artificial sequence
  Synthetic oligonucleotide
aatcatgctttgtatttgcttgaca

SEQ ID NO: 743133 - DNA, 25 bp, Artificial sequence
  Synthetic oligonucleotide
cactttttagatttatgtgatcaca

SEQ ID NO: 743134 - DNA, 25 bp, Artificial sequence
  Synthetic oligonucleotide
tactatattctctaaacgatggtgt

SEQ ID NO: 743135 - DNA, 25 bp, Artificial sequence
  Synthetic oligonucleotide
gaatgatctttgtaggtttaaagca

SEQ ID NO: 743136 - DNA, 25 bp, Artificial sequence
  Synthetic oligonucleotide
tcttcaaggataaacaaactcgaat

SEQ ID NO: 743137 - DNA, 25 bp, Artificial sequence
  Synthetic oligonucleotide
ttcctttggtgttaaaaagattgga

SEQ ID NO: 743138 - DNA, 25 bp, Artificial sequence
  Synthetic oligonucleotide
ttcctttggtgtaaaaaagattgga

SEQ ID NO: 743139 - DNA, 25 bp, Artificial sequence
  Synthetic oligonucleotide
gggaagaagaattcagctttttgca

SEQ ID NO: 743140 - DNA, 25 bp, Artificial sequence
  Synthetic oligonucleotide
gggaagaagaatacagctttttgca

SEQ ID NO: 743141 - DNA, 25 bp, Artificial sequence
  Synthetic oligonucleotide
gctaaagatgctatggtccctcttg

SEQ ID NO: 743142 - DNA, 25 bp, Artificial sequence
  Synthetic oligonucleotide
gctaaagatgctttggtccctcttg

SEQ ID NO: 743143 - DNA, 25 bp, Artificial sequence
  Synthetic oligonucleotide
gattccttcttcaaaagaaagaagc

SEQ ID NO: 743144 - DNA, 25 bp, Artificial sequence
  Synthetic oligonucleotide
gattccttcttctaaagaaagaagc

SEQ ID NO: 743145 - DNA, 25 bp, Artificial sequence
  Synthetic oligonucleotide
aaacagctttcctttaccgtgattc

SEQ ID NO: 743146 - DNA, 25 bp, Artificial sequence
  Synthetic oligonucleotide
aaacagctttccattaccgtgattc

SEQ ID NO: 743147 - DNA, 25 bp, Artificial sequence
  Synthetic oligonucleotide
tatttcatcgtatatttgtaatgcg

SEQ ID NO: 743148 - DNA, 25 bp, Artificial sequence
  Synthetic oligonucleotide
tatttcatcgtaaatttgtaatgcg

SEQ ID NO: 743149 - DNA, 25 bp, Artificial sequence
  Synthetic oligonucleotide
tgtgacactctcatgccctttgaag

SEQ ID NO: 743150 - DNA, 25 bp, Artificial sequence
  Synthetic oligonucleotide
cacgctagttcatcgatttcgatag

SEQ ID NO: 743151 - DNA, 25 bp, Artificial sequence
  Synthetic oligonucleotide
caagttcacacctgaaataaagttg

SEQ ID NO: 743152 - DNA, 25 bp, Artificial sequence
  Synthetic oligonucleotide
caagttcacaccagaaataaagttg

SEQ ID NO: 743153 - DNA, 25 bp, Artificial sequence
  Synthetic oligonucleotide
taaactagtgccaaggaagaaatgg

SEQ ID NO: 743154 - DNA, 25 bp, Artificial sequence
  Synthetic oligonucleotide
taaactagtgcctaggaagaaatgg

SEQ ID NO: 743155 - DNA, 25 bp, Artificial sequence
  Synthetic oligonucleotide
ccagaataaggaaagcgaagaagcg

SEQ ID NO: 743156 - DNA, 25 bp, Artificial sequence
  Synthetic oligonucleotide
gaacaccaaacagcctccaaaaata

SEQ ID NO: 743157 - DNA, 25 bp, Artificial sequence
  Synthetic oligonucleotide
cacgctagttcaacgatttcgatag

SEQ ID NO: 743158 - DNA, 25 bp, Artificial sequence
  Synthetic oligonucleotide
gaacaccaaacaccctccaaaaata

SEQ ID NO: 743159 - DNA, 25 bp, Artificial sequence
  Synthetic oligonucleotide
gagtccattcatactttcaaacgat

SEQ ID NO: 743160 - DNA, 25 bp, Artificial sequence
  Synthetic oligonucleotide
gagtccattcattctttcaaacgat

SEQ ID NO: 743161 - DNA, 25 bp, Artificial sequence
  Synthetic oligonucleotide
tcaaatccatttctttaaactaatc

SEQ ID NO: 743162 - DNA, 25 bp, Artificial sequence
  Synthetic oligonucleotide
tcaaatccatttgtttaaactaatc

SEQ ID NO: 743163 - DNA, 25 bp, Artificial sequence
  Synthetic oligonucleotide
gaatgatctttgaaggtttaaagca

SEQ ID NO: 743164 - DNA, 25 bp, Artificial sequence
  Synthetic oligonucleotide
aatagtaaaaatcaagcaatttgcc

SEQ ID NO: 743165 - DNA, 25 bp, Artificial sequence
  Synthetic oligonucleotide
ccagaataaggatagcgaagaagcg

SEQ ID NO: 743166 - DNA, 25 bp, Artificial sequence
  Synthetic oligonucleotide
catcaaatagataccggtgttgtct

SEQ ID NO: 743167 - DNA, 25 bp, Artificial sequence
  Synthetic oligonucleotide
cacgtttatcgttcatgccaggagc

SEQ ID NO: 743168 - DNA, 25 bp, Artificial sequence
  Synthetic oligonucleotide
cacgtttatcgtacatgccaggagc

SEQ ID NO: 743169 - DNA, 25 bp, Artificial sequence
  Synthetic oligonucleotide
aaacgattgagtcggattacggatg

SEQ ID NO: 743170 - DNA, 25 bp, Artificial sequence
  Synthetic oligonucleotide
aaacgattgagtgggattacggatg

SEQ ID NO: 743171 - DNA, 25 bp, Artificial sequence
  Synthetic oligonucleotide
cgtaattttcctggggagcgtttgc

SEQ ID NO: 743172 - DNA, 25 bp, Artificial sequence
  Synthetic oligonucleotide
cgtaattttcctcgggagcgtttgc

SEQ ID NO: 743173 - DNA, 25 bp, Artificial sequence
  Synthetic oligonucleotide
aatcatgctttgaatttgcttgaca

SEQ ID NO: 743174 - DNA, 25 bp, Artificial sequence
  Synthetic oligonucleotide
aacaagcggcgtcgacgttgtcgtc

SEQ ID NO: 743175 - DNA, 25 bp, Artificial sequence
  Synthetic oligonucleotide
tgaaaattccattaaacagcaccaa

SEQ ID NO: 743176 - DNA, 25 bp, Artificial sequence
  Synthetic oligonucleotide
taatcttttggttggttggctcaca

SEQ ID NO: 743177 - DNA, 25 bp, Artificial sequence
  Synthetic oligonucleotide
aaagtatacaaattacaaaatggag

SEQ ID NO: 743178 - DNA, 25 bp, Artificial sequence
  Synthetic oligonucleotide
aaagtatacaaaatacaaaatggag

SEQ ID NO: 743179 - DNA, 25 bp, Artificial sequence
  Synthetic oligonucleotide
tacaaagttccttcattaccttttg

SEQ ID NO: 743180 - DNA, 25 bp, Artificial sequence
  Synthetic oligonucleotide
tgtgacactctcttgccctttgaag

SEQ ID NO: 743181 - DNA, 25 bp, Artificial sequence
  Synthetic oligonucleotide
gcttaattggtcgattatacctatt

SEQ ID NO: 743182 - DNA, 25 bp, Artificial sequence
  Synthetic oligonucleotide
aatagtaaaaatgaagcaatttgcc

SEQ ID NO: 743183 - DNA, 25 bp, Artificial sequence
  Synthetic oligonucleotide
cacatgattctgttttttgggtctc

SEQ ID NO: 743184 - DNA, 25 bp, Artificial sequence
  Synthetic oligonucleotide
cacatgattctgatttttgggtctc

SEQ ID NO: 743185 - DNA, 25 bp, Artificial sequence
  Synthetic oligonucleotide
ttttattaatgtttgattattgtca

SEQ ID NO: 743186 - DNA, 25 bp, Artificial sequence
  Synthetic oligonucleotide
ttttattaatgtatgattattgtca

SEQ ID NO: 743187 - DNA, 25 bp, Artificial sequence
  Synthetic oligonucleotide
tacaaagttcctacattaccttttg

SEQ ID NO: 743188 - DNA, 25 bp, Artificial sequence
  Synthetic oligonucleotide
catgtcctatagtaattagacaaac

SEQ ID NO: 743189 - DNA, 25 bp, Artificial sequence
  Synthetic oligonucleotide
catcaaatagattccggtgttgtct

SEQ ID NO: 743190 - DNA, 25 bp, Artificial sequence
  Synthetic oligonucleotide
gcttaattggtccattatacctatt

SEQ ID NO: 743191 - DNA, 25 bp, Artificial sequence
  Synthetic oligonucleotide
gattctacatagcttatggttattg

SEQ ID NO: 743192 - DNA, 25 bp, Artificial sequence
  Synthetic oligonucleotide
gattctacataggttatggttattg

SEQ ID NO: 743193 - DNA, 25 bp, Artificial sequence
  Synthetic oligonucleotide
tcttggacaaaaagtattgttcgaa

SEQ ID NO: 743194 - DNA, 25 bp, Artificial sequence
  Synthetic oligonucleotide
tcttggacaaaatgtattgttcgaa

SEQ ID NO: 743195 - DNA, 25 bp, Artificial sequence
  Synthetic oligonucleotide
taatcttttggtaggttggctcaca

SEQ ID NO: 743196 - DNA, 25 bp, Artificial sequence
  Synthetic oligonucleotide
catgtcctatagaaattagacaaac

SEQ ID NO: 743197 - DNA, 25 bp, Artificial sequence
  Synthetic oligonucleotide
tccaagtagtagaccaggtgttcgt

SEQ ID NO: 743198 - DNA, 25 bp, Artificial sequence
  Synthetic oligonucleotide
aacatgggagaatgaaatggaggat

SEQ ID NO: 743199 - DNA, 25 bp, Artificial sequence
  Synthetic oligonucleotide
aacatgggagaaagaaatggaggat

SEQ ID NO: 743200 - DNA, 25 bp, Artificial sequence
  Synthetic oligonucleotide
taatgtgaaacctggtgatgatgac

SEQ ID NO: 743201 - DNA, 25 bp, Artificial sequence
  Synthetic oligonucleotide
taatgtgaaaccaggtgatgatgac

SEQ ID NO: 743202 - DNA, 25 bp, Artificial sequence
  Synthetic oligonucleotide
tatgcaagtggaagaggaaaagact

SEQ ID NO: 743203 - DNA, 25 bp, Artificial sequence
  Synthetic oligonucleotide
tatgcaagtggatgaggaaaagact

SEQ ID NO: 743204 - DNA, 25 bp, Artificial sequence
  Synthetic oligonucleotide
acttcggttgttacaatgtgttgca

SEQ ID NO: 743205 - DNA, 25 bp, Artificial sequence
  Synthetic oligonucleotide
acttcggttgtttcaatgtgttgca

SEQ ID NO: 743206 - DNA, 25 bp, Artificial sequence
  Synthetic oligonucleotide
gatattgtttaaaagtagagtctca

SEQ ID NO: 743207 - DNA, 25 bp, Artificial sequence
  Synthetic oligonucleotide
gatattgtttaatagtagagtctca

SEQ ID NO: 743208 - DNA, 25 bp, Artificial sequence
  Synthetic oligonucleotide
tttttttggaattgagtacacactg

SEQ ID NO: 743209 - DNA, 25 bp, Artificial sequence
  Synthetic oligonucleotide
tttttttggaatagagtacacactg

SEQ ID NO: 743210 - DNA, 25 bp, Artificial sequence
  Synthetic oligonucleotide
tggtcaggaagtgaagacgaaagca

SEQ ID NO: 743211 - DNA, 25 bp, Artificial sequence
  Synthetic oligonucleotide
ccgcagagagtttatttgttcatga

SEQ ID NO: 743212 - DNA, 25 bp, Artificial sequence
  Synthetic oligonucleotide
aattgggtatttcctgagtttcgtc

SEQ ID NO: 743213 - DNA, 25 bp, Artificial sequence
  Synthetic oligonucleotide
tccaagtagtagtccaggtgttcgt

SEQ ID NO: 743214 - DNA, 25 bp, Artificial sequence
  Synthetic oligonucleotide
tatattggtgtctttagtttttttg

SEQ ID NO: 743215 - DNA, 25 bp, Artificial sequence
  Synthetic oligonucleotide
tatattggtgtcattagtttttttg

SEQ ID NO: 743216 - DNA, 25 bp, Artificial sequence
  Synthetic oligonucleotide
taagcctctatgatatctccgagcc

SEQ ID NO: 743217 - DNA, 25 bp, Artificial sequence
  Synthetic oligonucleotide
taagcctctatgttatctccgagcc

SEQ ID NO: 743218 - DNA, 25 bp, Artificial sequence
  Synthetic oligonucleotide
caaggtttcattattctccaacatg

SEQ ID NO: 743219 - DNA, 25 bp, Artificial sequence
  Synthetic oligonucleotide
caaggtttcatttttctccaacatg

SEQ ID NO: 743220 - DNA, 25 bp, Artificial sequence
  Synthetic oligonucleotide
aattgggtatttgctgagtttcgtc

SEQ ID NO: 743221 - DNA, 25 bp, Artificial sequence
  Synthetic oligonucleotide
caaagtcgcttggtttcgtgtccga

SEQ ID NO: 743222 - DNA, 25 bp, Artificial sequence
  Synthetic oligonucleotide
tacgaagctgatctagtttctctgt

SEQ ID NO: 743223 - DNA, 25 bp, Artificial sequence
  Synthetic oligonucleotide
tacgaagctgatgtagtttctctgt

SEQ ID NO: 743224 - DNA, 25 bp, Artificial sequence
  Synthetic oligonucleotide
tcttcaaggatatacaaactcgaat

SEQ ID NO: 743225 - DNA, 25 bp, Artificial sequence
  Synthetic oligonucleotide
aacaagcggcgtggacgttgtcgtc

SEQ ID NO: 743226 - DNA, 25 bp, Artificial sequence
  Synthetic oligonucleotide
ccgcagagagttaatttgttcatga

SEQ ID NO: 743227 - DNA, 25 bp, Artificial sequence
  Synthetic oligonucleotide
cctgaggagcttacacccggtaaaa

SEQ ID NO: 743228 - DNA, 25 bp, Artificial sequence
  Synthetic oligonucleotide
caaagtcgcttgctttcgtgtccga

SEQ ID NO: 743229 - DNA, 25 bp, Artificial sequence
  Synthetic oligonucleotide
tgaaaacattatgtcgggacctgag

SEQ ID NO: 743230 - DNA, 25 bp, Artificial sequence
  Synthetic oligonucleotide
taagaaaaggtgcacccaagagact

SEQ ID NO: 743231 - DNA, 25 bp, Artificial sequence
  Synthetic oligonucleotide
tgaaaacattatctcgggacctgag

SEQ ID NO: 743232 - DNA, 25 bp, Artificial sequence
  Synthetic oligonucleotide
gtaatgagtgatgttgacattctga

SEQ ID NO: 743233 - DNA, 25 bp, Artificial sequence
  Synthetic oligonucleotide
aaagggcctgatcggcgctacacaa

SEQ ID NO: 743234 - DNA, 25 bp, Artificial sequence
  Synthetic oligonucleotide
aaagggcctgatgggcgctacacaa

SEQ ID NO: 743235 - DNA, 25 bp, Artificial sequence
  Synthetic oligonucleotide
agcttgctgttgagaacgcgttgaa

SEQ ID NO: 743236 - DNA, 25 bp, Artificial sequence
  Synthetic oligonucleotide
tggtcaggaagtcaagacgaaagca

SEQ ID NO: 743237 - DNA, 25 bp, Artificial sequence
  Synthetic oligonucleotide
cctgaggagctttcacccggtaaaa

SEQ ID NO: 743238 - DNA, 25 bp, Artificial sequence
  Synthetic oligonucleotide
gtaatgagtgatcttgacattctga

SEQ ID NO: 743239 - DNA, 25 bp, Artificial sequence
  Synthetic oligonucleotide
caatctcagagtagttgaaatctga

SEQ ID NO: 743240 - DNA, 25 bp, Artificial sequence
  Synthetic oligonucleotide
caatctcagagttgttgaaatctga

SEQ ID NO: 743241 - DNA, 25 bp, Artificial sequence
  Synthetic oligonucleotide
gttgtttgagtttgaggagaaacca

SEQ ID NO: 743242 - DNA, 25 bp, Artificial sequence
  Synthetic oligonucleotide
caagaaagcggaagaaaccgtcttg

SEQ ID NO: 743243 - DNA, 25 bp, Artificial sequence
  Synthetic oligonucleotide
taagaaaaggtggacccaagagact

SEQ ID NO: 743244 - DNA, 25 bp, Artificial sequence
  Synthetic oligonucleotide
agcttgctgttgtgaacgcgttgaa

SEQ ID NO: 743245 - DNA, 25 bp, Artificial sequence
  Synthetic oligonucleotide
caagaaagcggatgaaaccgtcttg

SEQ ID NO: 743246 - DNA, 25 bp, Artificial sequence
  Synthetic oligonucleotide
gttgtttgagttagaggagaaacca

SEQ ID NO: 743247 - DNA, 25 bp, Artificial sequence
  Synthetic oligonucleotide
gaaagctagacatcaagctaaggat

SEQ ID NO: 743248 - DNA, 25 bp, Artificial sequence
  Synthetic oligonucleotide
gaaagctagacaacaagctaaggat

SEQ ID NO: 743249 - DNA, 25 bp, Artificial sequence
  Synthetic oligonucleotide
caaattgatggagatgatagtgatg

SEQ ID NO: 743250 - DNA, 25 bp, Artificial sequence
  Synthetic oligonucleotide
ggtcaggaagtgatgaggaaaaaac

SEQ ID NO: 743251 - DNA, 25 bp, Artificial sequence
  Synthetic oligonucleotide
ggtcaggaagtgttgaggaaaaaac

SEQ ID NO: 743252 - DNA, 25 bp, Artificial sequence
  Synthetic oligonucleotide
cgatgaaggtgatgatgacgacgat

SEQ ID NO: 743253 - DNA, 25 bp, Artificial sequence
  Synthetic oligonucleotide
cgatgaaggtgaagatgacgacgat

SEQ ID NO: 743254 - DNA, 25 bp, Artificial sequence
  Synthetic oligonucleotide
cacgcccgaacgtggcatctgataa

SEQ ID NO: 743255 - DNA, 25 bp, Artificial sequence
  Synthetic oligonucleotide
caaattgatggacatgatagtgatg

SEQ ID NO: 743256 - DNA, 25 bp, Artificial sequence
  Synthetic oligonucleotide
cacgcccgaacgaggcatctgataa
